US008586526B2

(12) United States Patent
Gregory et al.

(10) Patent No.: US 8,586,526 B2
(45) Date of Patent: Nov. 19, 2013

(54) DNA-BINDING PROTEINS AND USES THEREOF

(75) Inventors: Philip D. Gregory, Orinda, CA (US); Jeffrey C. Miller, San Leandro, CA (US); David Paschon, Oakland, CA (US); Edward J. Rebar, San Francisco, CA (US); Siyuan Tan, Lexington, MA (US); Fyodor Urnov, Richmond, CA (US); Lei Zhang, Davis, CA (US)

(73) Assignee: Sangamo BioSciences, Inc., Richmond, CA (US)

( * ) Notice: Subject to any disclaimer, the term of this patent is extended or adjusted under 35 U.S.C. 154(b) by 0 days.

(21) Appl. No.: 13/068,735

(22) Filed: May 17, 2011

(65) Prior Publication Data

US 2011/0301073 A1 Dec. 8, 2011

Related U.S. Application Data

(60) Provisional application No. 61/395,836, filed on May 17, 2010, provisional application No. 61/401,429, filed on Aug. 12, 2010, provisional application No. 61/455,121, filed on Oct. 13, 2010, provisional application No. 61/459,891, filed on Dec. 20, 2010, provisional application No. 61/462,482, filed on Feb. 2, 2011, provisional application No. 61/465,869, filed on Mar. 24, 2011.

(51) Int. Cl.
*A61K 38/00* (2006.01)
*C12Q 1/37* (2006.01)
*C12P 19/34* (2006.01)
*C07K 7/23* (2006.01)

(52) U.S. Cl.
USPC ............... 514/1.1; 435/23; 435/91.1; 930/20

(58) Field of Classification Search
None
See application file for complete search history.

(56) References Cited

U.S. PATENT DOCUMENTS

| 4,179,337 | A | 12/1979 | David et al. |
| 4,683,195 | A | 7/1987 | Mullis et al. |
| 4,761,373 | A | 8/1988 | Anderson et al. |
| 4,769,061 | A | 9/1988 | Comai |
| 4,810,648 | A | 3/1989 | Stalker |
| 4,940,835 | A | 7/1990 | Shah et al. |
| 4,959,317 | A | 9/1990 | Sauer |
| 4,975,374 | A | 12/1990 | Goodman et al. |
| 5,006,333 | A | 4/1991 | Saifer et al. |
| 5,013,659 | A | 5/1991 | Bedbrook et al. |
| 5,162,602 | A | 11/1992 | Somers et al. |
| 5,204,253 | A | 4/1993 | Sanford et al. |
| 5,276,268 | A | 1/1994 | Strauch et al. |
| 5,356,802 | A | 10/1994 | Chandrasegaran |
| 5,436,150 | A | 7/1995 | Chandrasegaran |
| 5,487,994 | A | 1/1996 | Chandrasegaran |
| 5,501,967 | A | 3/1996 | Offringa et al. |
| 5,538,880 | A | 7/1996 | Lundquist et al. |
| 5,554,798 | A | 9/1996 | Lundquist et al. |
| 5,561,236 | A | 10/1996 | Leemans et al. |
| 5,591,616 | A | 1/1997 | Hiei et al. |
| 5,767,366 | A | 6/1998 | Sathasivan et al. |
| 5,789,538 | A | 8/1998 | Rebar et al. |
| 5,792,640 | A | 8/1998 | Chandrasegaran |
| 5,879,903 | A | 3/1999 | Strauch et al. |
| 5,925,523 | A | 7/1999 | Dove et al. |
| 5,928,937 | A | 7/1999 | Kakefuda et al. |
| 6,007,988 | A | 12/1999 | Choo et al. |
| 6,013,453 | A | 1/2000 | Choo et al. |
| 6,084,155 | A | 7/2000 | Volrath et al. |
| 6,140,466 | A | 10/2000 | Barbas et al. |
| 6,200,759 | B1 | 3/2001 | Dove et al. |
| 6,242,568 | B1 | 6/2001 | Barbas et al. |
| 6,326,166 | B1 | 12/2001 | Pomerantz et al. |
| 6,329,571 | B1 | 12/2001 | Hiei |
| 6,368,227 | B1 | 4/2002 | Olson |
| 6,410,248 | B1 | 6/2002 | Greisman et al. |
| 6,451,732 | B1 | 9/2002 | Beckett et al. |
| 6,451,735 | B1 | 9/2002 | Ottaway et al. |
| 6,453,242 | B1 | 9/2002 | Eisenberg et al. |
| 6,479,626 | B1 | 11/2002 | Kim et al. |
| 6,503,717 | B2 | 1/2003 | Case et al. |
| 6,534,261 | B1 | 3/2003 | Cox et al. |
| 6,599,692 | B1 | 7/2003 | Case et al. |
| 6,607,882 | B1 | 8/2003 | Cox et al. |
| 6,689,558 | B2 | 2/2004 | Case |
| 6,824,978 | B1 | 11/2004 | Cox et al. |
| 6,903,185 | B2 | 6/2005 | Kim et al. |

(Continued)

FOREIGN PATENT DOCUMENTS

| EP | 0242246 | 10/1987 |
| EP | 02206723 A1 | 7/2010 |

(Continued)

OTHER PUBLICATIONS

Bedford et al., The Journal of Biological Chemistry, 2000, vol. 275, No. 21, Issue of May 26, pp. 16030-16036.*
Côté et. al., Molecular Biology of the Cell, vol. Jan. 2003, 14, 274-287.*
Bartsevich, et al., "Engineered Zinc Finger Protein for Controlling Stem Cell Fate," *Stem Cells* 21:632-637 (2003).
Bitinate, et al., "FokI Dimerization Is Required for DNA Cleavage," *PNAS USA* 95:10570-10575 (1998).
Boch, et al., "Breaking the Code of DNA Binding Specificity of TAL-Type III Effectors," *Science* 326:1509-1512 (2009).
Boch, et al., "*Xanthomonas* AVRBS3 Family-Type III Effectors: Discovery and Function," *Annual Review of Phytopathology* 48:419-436 (2010).

(Continued)

*Primary Examiner* — Marcela M Cordero Garcia
*Assistant Examiner* — Kaipeen Yang
(74) *Attorney, Agent, or Firm* — Pasternak Patent Law; Danna S. Pasternak

(57) ABSTRACT

Disclosed herein are polypeptides, polynucleotides encoding, cells and organisms comprising novel DNA-binding domains, including TALE DNA-binding domains. Also disclosed are methods of using these novel DNA-binding domains for modulation of gene expression and/or genomic editing of endogenous cellular sequences.

11 Claims, 32 Drawing Sheets

(56) References Cited

U.S. PATENT DOCUMENTS

| | | | |
|---|---|---|---|
| 6,933,113 B2 | 8/2005 | Case et al. |
| 6,979,539 B2 | 12/2005 | Cox et al. |
| 7,001,768 B2 | 2/2006 | Wolffe |
| 7,013,219 B2 | 3/2006 | Case et al. |
| 7,067,317 B2 | 6/2006 | Rebar et al. |
| 7,070,934 B2 | 7/2006 | Cox, III et al. |
| 7,153,949 B2 | 12/2006 | Kim et al. |
| 7,163,824 B2 | 1/2007 | Cox et al. |
| 7,220,719 B2 | 5/2007 | Case et al. |
| 7,262,054 B2 | 8/2007 | Jamieson et al. |
| 7,273,923 B2 | 9/2007 | Jamieson et al. |
| 7,285,416 B2 | 10/2007 | Choo et al. |
| 7,361,635 B2 | 4/2008 | Miller et al. |
| 7,521,241 B2 | 4/2009 | Choo et al. |
| 7,842,489 B2 | 11/2010 | Arnould et al. |
| 2001/0016956 A1 | 8/2001 | Ward et al. |
| 2002/0160940 A1 | 10/2002 | Case et al. |
| 2003/0232410 A1 | 12/2003 | Liljedahl et al. |
| 2005/0026157 A1 | 2/2005 | Baltimore et al. |
| 2005/0064474 A1 | 3/2005 | Urnov et al. |
| 2005/0208489 A1 | 9/2005 | Carroll et al. |
| 2005/0222012 A1 | 10/2005 | Hemmenway |
| 2006/0063231 A1 | 3/2006 | Li et al. |
| 2006/0188987 A1 | 8/2006 | Guschan et al. |
| 2007/0134796 A1 | 6/2007 | Holmes et al. |
| 2007/0141038 A1 | 6/2007 | Choulika et al. |
| 2007/0218528 A1 | 9/2007 | Miller et al. |
| 2008/0015164 A1 | 1/2008 | Collingwood |
| 2008/0131962 A1 | 6/2008 | Miller |
| 2008/0159996 A1 | 7/2008 | Ando et al. |
| 2008/0182332 A1 | 7/2008 | Cai et al. |
| 2008/0299580 A1 | 12/2008 | DeKelver et al. |
| 2009/0133158 A1 | 5/2009 | Lahaye et al. |
| 2009/0205083 A1 | 8/2009 | Gupta et al. |
| 2009/0271881 A1 | 10/2009 | Arnould et al. |
| 2009/0305402 A1 | 12/2009 | Liljedahl et al. |
| 2009/0311787 A1 | 12/2009 | Miller |
| 2010/0132069 A1 | 5/2010 | Lahaye et al. |
| 2011/0014616 A1 | 1/2011 | Holmes et al. |
| 2011/0041195 A1 | 2/2011 | Doyon |
| 2011/0129898 A1 | 6/2011 | Doyon |
| 2011/0136895 A1 | 6/2011 | Gregory et al. |
| 2011/0145940 A1 | 6/2011 | Voytas et al. |
| 2011/0158957 A1 | 6/2011 | Bonini et al. |
| 2011/0167521 A1 | 7/2011 | DeKelver et al. |
| 2011/0201055 A1 | 8/2011 | Doyon et al. |
| 2011/0201118 A1 | 8/2011 | Yang et al. |
| 2011/0203012 A1 | 8/2011 | Dotson et al. |
| 2011/0207221 A1 | 8/2011 | Cost et al. |
| 2011/0247089 A1 | 10/2011 | Doyon et al. |
| 2011/0265198 A1 | 10/2011 | Gregory et al. |
| 2011/0269234 A1 | 11/2011 | Doyon et al. |
| 2011/0287545 A1 | 11/2011 | Cost et al. |
| 2011/0301073 A1 | 12/2011 | Gregory et al. |
| 2012/0178131 A1 | 7/2012 | Voytas et al. |
| 2012/0178169 A1 | 7/2012 | Voytas et al. |
| 2012/0214228 A1 | 8/2012 | Voytas et al. |
| 2012/0246764 A1 | 9/2012 | Hlubek et al. |
| 2012/0284877 A1 | 11/2012 | Hlubek et al. |
| 2012/0324603 A1 | 12/2012 | Hlubek et al. |

FOREIGN PATENT DOCUMENTS

| | | |
|---|---|---|
| EP | 2392208 | 12/2011 |
| GB | 2338237 A | 12/1999 |
| WO | WO94/18313 | 8/1994 |
| WO | WO95/09233 | 4/1995 |
| WO | WO 95/19431 A1 | 7/1995 |
| WO | WO 96/06166 A1 | 2/1996 |
| WO | WO 98/37186 A1 | 8/1998 |
| WO | WO 98/53057 A1 | 11/1998 |
| WO | WO 98/53058 A1 | 11/1998 |
| WO | WO 98/53059 A1 | 11/1998 |
| WO | WO 98/53060 A1 | 11/1998 |
| WO | WO 98/54311 A1 | 12/1998 |
| WO | WO 00/27878 A1 | 5/2000 |
| WO | WO 01/60970 A2 | 8/2001 |
| WO | WO 01/83732 A2 | 11/2001 |
| WO | WO 01/83793 A2 | 11/2001 |
| WO | WO 01/88197 A2 | 11/2001 |
| WO | WO 02/099084 A2 | 12/2002 |
| WO | WO 2007/014275 A2 | 1/2007 |
| WO | WO2007/060495 | 5/2007 |
| WO | WO 2007/139982 A2 | 12/2007 |
| WO | WO 2009/054985 A1 | 4/2009 |
| WO | WO2009/095793 | 8/2009 |
| WO | WO 2010/054348 A2 | 5/2010 |
| WO | WO 2010/079430 A1 | 7/2010 |
| WO | WO 2010/143917 A2 | 12/2010 |
| WO | WO2011/017293 | 2/2011 |
| WO | WO2011/019385 | 2/2011 |
| WO | WO2011/072246 | 6/2011 |
| WO | WO2011/100058 | 8/2011 |
| WO | WO2011/154393 | 12/2011 |

OTHER PUBLICATIONS

Bogdanove, et al., "TAL Effectors: Finding Plant Genes for Disease and Defense," *Current Opinion in Plant Biology* 13:394-401 (2010).
Bogdanove, et al., "TAL Effectors: Customizable Proteins for DNA Targeting," *Science* 333:1843-1846 (2011).
Bonas, et al., "Genetic and Structural Characterization of the Avirulence Gene AVRBS3 From *Xanthomonas campestris* Pv. *vesicatoria*," *Mol Gen Genet* 218:127-136 (1989).
Cai, et al., "Targeted Transgene Integration in Plant Cells Using Designed Zinc Finger Nucleases," *Plant Mol Biol* 69:699-709 (2009).
Cernak, et al., "Efficient Design and Assembly of Custom Talen and Other TAL Effector-Based Constructs for DNA Targeting," *Nucleic Acids Research* epub doi:10.1093/nar/gkr218 (2011).
Christian, et al., "Targeting DNA Double-Strand Breaks With TAL Effector Nucleases," *Genetics* 186:757-761 (2010).
Doyon, et al., "Enhancing Zinc-Finger-Nuclease Activity With Improved Obligate Heterodimeric Architectures," *Nat Methods* 8(1):74-79 (2010).
Geibler, et al., "Transcriptional Activators of Human Genes With Programmable DNA-Specificity," *PLos One* 6(5) e19509 (2011).
Gossen, et al., "Tight Control of Gene Expression in Mammalian Cells by Tetracycline-Responsive Promoter," *PNAS USA* 89:5547-5551 (1992).
Gu, et al., "Transcription Activator-Like Type III Effector AVRXA27 Depends on OSTFIIAG5 for the Activation of XA27 Transcription in Rice That Triggers Disease Resistance to *Xanthomonas oryzae* Pv. *oryzae*," *Molecular Plant Pathology* 10(6):829-835 (2009).
Guo, et al., "Directed Evolution of an Enhanced and Highly Efficient FokI Cleavage Domain for Zinc Finger Nucleases," *J Mol Biol* 400:96-107 (2010).
Gurlebeck, et al., "Dimeration of the Bacterial Effector Protein AVRBS3 in the Plant Cell Cytoplasm Prior to Nuclear Im Port," *The Plant Journal* 42:175-187 (2005).
Gurlebeck, et al., "Type III Effector Proteins From the Plant Pathogen *Xanthomonas* and Their Role in the Interaction With the Host Plant," *J. Plant Physiology* 163:233-255 (2006).
Hammerschmidt, et al., "Strategies to Perturb Zebrafish Development," *Methods Cell Biol* 59:87-115 (1999).
Heuer, et al., "Repeat Domain Diversity of AVRBS3-Like Genes in *Ralstonia solanacearum* Strains and Association With Host Preferences in the Field," *Appl and Envir Micro* 73:4379-4384 (2007).
Hou, et al., "An Interleukin-4-Induced Transcription Factor: IL-4 Stat," *Science* 256:1701-1706 (1994).
Kay, et al., "A Bacterial Effectors Acts As a Plant Transcription Factor and Induces a Cell Size Regulator," *Science* 318:648-651 (2007).
Kay, et al., "How *Xanthomonas* Type III Effectors Manipulate the Host Plant," *Current Opinion in Microbiology* 12: 37-43 (2009).
Kay, et al., "Detailed Analysis of the DNA Recognition Motifs of the *Xanthomonas* Type III Effectors AVRBS3 and AVRBS3DREP16," *The Plant Journal* 59:859-871 (2009).
Kim, et al., "Chimeric Restriction Endonuclease," *PNAS USA* 91:883-887 (1994).

(56) References Cited

OTHER PUBLICATIONS

Kim, et al., "Insertion and Deletion Mutants of FokI Restriction Endonuclease," *J. Biol. Chem.* 269:31978-31982 (1994).
Lahaye, et al., "Molecular Secrets of Bacterial Type III Effector Proteins," *Trends in Plant Science* 6(10):479-485 (2001).
Li, et al., "Functional Domains in Fok I Restriction Endonuclease," *PNAS USA* 89:4275-4279 (1992).
Li, et al., "Alteration of the Cleavage Distance of Fok I Restriction Endonuclease by Insertion Mutagenesis," *PNAS USA* 90:2764-2768 (1993).
Li, et al , "TAL Nucelases (TALNs): Hybrid Proteins Composed of TAL Effectors and Fok1 DNA-Cleavage Domain," *Nucleic Acids Research* 39(1):359-372 Epub Aug. 10, 2010.
Li, et al , "Modularly Assembled Designer TAL Effector Nucleases for Targeted Gene Knockout and Gene Replacement in Eukaryotes," *Nucleic Acids Research* epub doi:0.1093/nar/gkr188 (2011).
Lombardo, et al., "Gene Editing in Human Stem Cells Using Zinc Finger Nucleases and Integrase-Defective Lentiviral Vector Delivery," *Nature Biotechnology* 25:1298-1306 (2007).
Mahfouz, et al., "De Novo-Engineered Transcription Activator-Like Effector (TALE) Hybrid Nuclease With Novel DNA Binding Specificity Creates Double-Strand Breaks," *PNAS USA* 108(6):2623-2628 (2011).
Mapp, et al., "Activation of Gene Expression by Small Molecule Transcription Factors," *PNAS USA* 97:3930-3935 (2000).
Menoret, et al., "Characterization of Immunoglobulin Heavy Chain Knockout Rats," *Eur J Immunol* 40:2932-2941 (2010).
Miller, et al., "A TALE Nuclease Architecture for Efficient Genome Editing," *Nature Biotechnology* 29(2):143-150 (2011).
Morbitzer, et al., "Regulation of Selected Genome Loci Using De Novo Engineered Transcription Activator-Like Effector (TALE)-Type Transcription Factors," *PNAS USA* 107:21617-21622 (2010).
Moscou, et al., "A Simple Cipher Governs DNA Recognition by TAL Effectors," *Science* 326:1501 (2009).
Neering, et al., "Transduction of Primitive Human Hematopoietic Cells With Recombinant Adenovirus Vectors," *Blood* 88:1147-1155 (1996).
Oligino, et al., "Drug Inducible Transgene Expression in Brain Using a Herpes Simplex Virus Vector," *Gene Ther.* 5:491-496 (1998).
Perez, et al., "Establishment of HIV-1 Resistance in CD4+ T Cells by Genome Editing Using Zinc-Finger Nucleases," *Nature Biotechnology* 26:808-816 (2008).
Rebar, "Development of Pro-Angiogenic Engineered Transcription Factors for the Treatment of Cardiovascular Disease," *Expert Opin Investig Drugs* 13:829-839 (2004).
Rendahl, et al., "Regulation of Gene Expression In Vivo Following Transduction by Two Separate rAAV Vectors," *Nat. Biotechnol.* 16:757-761 (1998).
Romer, et al., "Plant Pathogen Recognition Mediated by Promoter Activation of the Pepper BS3 Resistance Gene," *Science* 318:645-648 (2007).
Romer, et al., "Recognition of AVRBS3-Like Proteins Is Mediated By Specific Binding to Promoters of Matching Pepper BS3 Alleles," *Plant Physiology* 150:1697-1712 (2009).
Romer, et al., "Promoter Elements of Rice Susceptibility Genes Are Bound and Activated By Specific TAL Effectors From the Bacterial Blight Pathogen, *Xanthomonas oryzae* Pv. *oryzae*," *New Phytologist* 187:1048-1058 (2010).
Rossi, et al., "Genetic Therapies Against HIV," *Nature Biotech* 25:1444-1454 (2007).
Santiago, et al., "Targeted Gene Knockout in Mammalian Cells by Using Engineered Zinc Finger Nucleases," *PNAS USA* 105:5809-5814 (2008).
Scholze, et al., "TAL Effectors Are Remote Controls for Gene Activation," *Current Opinion in Microbiology* 14:1-7 (2010).
Scholze, et al., "TAL Effector-DNA Specificity," *Virulence* 1:428-432 (2010).
Schornack, et al., "Gene-for-Gene-Mediated Recognition of Nuclear-Targeted AVRBS3-Like Bacterial Effector Proteins," *J Plant Physiol* 163:256-272 (2006).
Schornack, et al., "Characterization of AVRHAH1, a Novel AVRBS3-Like Effector From *Xanthomonas gardneri* With Virulence and Avirulence Activity," *New Phytologist* 179:546 (2008).
Shukla, et al., "Precise Genome Modification in the Crop Species *Zea mays* Using Zinc-Finger Nucleases," *Nature* 459:437-441 (2009).
Stephens, et al., "Dating the Origin of the CCR5-D32 AIDS-Resistance Allele by the Coalescence of Haplotypes," *Am J Huma Gen* 62:1507-1515 (1998).
Szurek, et al., "Eukaryotic Features of the *Xanthomonas* Type III Effector AVRBS3: Protein Domains Involved In Transcriptional Activation and the Interaction With Nuclear Import Receptors From Pepper," *The Plant Journal* 26:523-534 (2001).
Szurek, et al., "Type III-Dependent Translocation of the *Xanthomonasa*VRBS3 Protein Into the Plant Cell," *Molecular Microbiology* 46:13-23 (2002).
Vivian, et al., "Avirulence Genes in Plant-Pathogenic Bacteria: Signals or Weapons?" *Microbiology* 143:693-704 (1997).
Voytas, et al., "DNA Binding Made Easy," *Science* 326:1491-1492 (2009).
Wang, et al., "Postive and Negative Regulation of Gene Expression in Eukaryotic Cells With an Inducible Transcritional Regulator," *Gene Ther.* 4:432-441 (1997).
Weber, et al., "Assemblyof Designer TAL Effectors by Golden Gate Cloning," *PLoS One* 6(5) e19722 (2011).
Yang, et al., "Host-Specific Symptoms and Increased Release of *Xanthomonas citri* and *X, camperstris* Pv. *malvacearum* From Leaves Are Determined by the 102-BP Tandem Repeats of PTHA and AVRB6, Respectively," *MPMI* 7(3):345-355 (1994).
Yang, et al., "The Virulence Factor AVRXA7 of *Xanthomonas oryzae* Pv. *oryzae* Is a Type III Secretion Pasthway-Dependent Nuclear-Localized Double-Stranded DNA-Binding Protein," *PNAS USA* 97:9807-912 (2000).
Yu, et al., "An Engineered VEGF-Activating Zinc Finger Protein Transcription Factor Improves Blood Flow and Limb Salvage In Advanced-Age Mice," *FASEB J* J20:479-481 (2006).
Zaremba, et al., "Generation of the BFII Restriction Endonuclease From the Fusion of a DNA Recognition Domain to a Non-Specific Nuclease From the Phospholipase D Superfamily," *J. Mol Biol* 336:81-92 (2004).
Zhang, et al., "Efficient Construction of Sequence-Specific TAL Effectors for Modulating Mammalian Transcription," *Nature Biotechnology* 29:149-153 (2011).
Zhu, et al., "AVRXA10 Contains an Acidic Transcriptional Activation Domain In the Functionally Conserved C Terminus," *MPMI* 11(8): 824-832 (1998).
Sera, "Inhibition of Virus DNA Replication by Artificial Zinc Finger Proteins", Journal of Virology, Feb. 2005, vol 79, No. 4, pp. 2614-2619.
Studholme et al., "Genome-wide sequencing data reveals virulence factors implicated in banana Xanthomonas wilt", Federation of European Microbiological Sociaties, 2010, vol. 310, pp. 182-192, Blackwell Publishing Ltd.
Sugio et al., "Two type III effector genes of Xanthomonas oryzae pv. oryzae control the induction of the host genes OsTFIIAgamma1 and OsTFX1 during bacterial blight of rice", Proceedings of the National Academy of Sciences USA, Jun. 19, 2007, vol. 104, No. 25, pp. 10720-10725.
Swarup et al., "An Xanthomonas citri Pathogenicity Gene, pthA, Pleiotropically Encodes Gratuitous Avirulence on Nonhosts", Molecular Plant-Microbe Interactions, 1992, vol. 5, No. 3, pp. 204-213.
Takenaka et al. "Inhibition of tomato yellow leaf curl virus replication by artificial zinc-finger proteins", Nucleic Acids Symposium Series, 2007, No. 51, pp. 429-430.
Thieme et al., "New Type III Effectors from Xanthomonas campestris pv. vesicatoria Trigger Plant Reactions Dependent on a Conserved N-Myristoylation Motif", Molecular Plant-Microbe Interactions, 2007, vol. 20, No. 10, pp. 1250-1261.
Thierry et al. "Cleavage of Yeast and Bacteriophage T7 Genomes at a Single Site Using the Rare Cutter Endoculease I-Sce I", Nucleic Acids Research, 1991, vol. 19, No. 1, pp. 189-190.

(56) References Cited

OTHER PUBLICATIONS

Tovkach et al, "A Toolbox and Procedural Notes for Characterizing Novel Zinc Finger Nucleases for Genome Editing In Plant Cells", The Plant Journal, 2009, vol. 57, pp. 747-757.
Townsend et al., "High frequency modification of plant genes using engineered zinc-finger nucleases", Nature, May 21, 2009, vol. 459(7245), pp. 442-445, Available in PMC Nov. 21, 2009.
Urnov et al. "Highly Efficient Endogenous Human Gene Correction Using Designed Zinc-Finger Nucleases", Nature, Jun. 2005, vol. 435, pp. 646-651.
Van Den Ackerveken et al., "Recognition of the Bacterial Avirulence Protein AvrBs3 Occurs Inside the Host Plant Cell", Cell. Dec. 27, 1996, vol. 87, pp. 1307-1316.
Vergunst et al, "VirB/D4-Dependent Protein Translocation from Agrobacterium into Plant Cells", Science, Nov. 3, 2000, vol. 290, pp. 979-982
Wah et al., "Structure of FokI has Implications for DNA Cleavage", Proceedings of the National Academy of Sciences USA, Sep. 1998, vol. 95, pp. 10564-10569.
Wah et al., "Structure of the Multimodular Endonuclease FokI Bound to DNA", Nature, Jul. 3, 1997, vol. 388, pp. 97-100.
Weber et al., "The type III-Dependent Hrp Pilus is Required for Productive Interaction of Xanthomonas campestri pv. vesicatoria with Pepper Host Plants", Journal of Bacteriology, Apr. 2005, vol. 187, No. 7, pp. 2458-2468.
White et al., 2009, "The type III effectors of Xanthomonas", Molecular Plant Pathology, 2009, vol. 10, No. 6, pp. 749-66.
White et al., 2009. "Host and Pathogen Factors Controlling the Rice-Xanthomonas oryzae Interaction", Plant Physiology, Aug. 2009, vol. 150, pp. 1677-86.
Wright et al., "High-Frequency Homologous Recombination in Plants Mediated by Zinc-Finger Nucleases", The Plant Journal, 2005, vol. 44, pp. 693-705.
Yang et al., "Os8N3 is a host disease-susceptibliity gene for bacterial blight of rice", Proceedings of the National Academy of Sciences USA, Jul. 5, 2006, vol. 103, No. 27, pp. 10503-10508.
Yang et al., "Avoidance of Host Recognition by Alterations in the Repetitive and C-Terminal Regions of AvrXa7, a Type III Effector of Xanthomonas oryzae pv. oryzae", Molecular Plant-Microbe Interactions, 2005, vol. 18, No. 2, pp. 142-149.
Yang et al., "Diverse Members of the AvrBs3/PthA Family of Type III Effectors are Major Virulence Determinants in Bacterial Blight Disease of Rice", Molecular Plant-Microbe Interactions, 2004, vol. 17, No. 11, pp. 1192-1200.
Yuan et al., "Characterization of Xanthomonas oryzae-Responsive cis-Acting Element in the Promoter of Rice Race-Specific Susceptibility Gene Xa13", Molecular Plant, 2010, 10 pages, Epub Jan. 5, 2011.
Zhang et al., "High frequency targeted mutagenesis in Arabidopsis thaliana using zinc finger nucleases", Proceedings of the National Academy of Sciences USA, Jun. 29, 2010, vol. 107, No. 26, pp. 12028-12033.
Zhu et al., "The C Terminus of AvrXa10 Can Be Replaced by the Transcriptional Activation Domain of VP 16 from the Herpes Simplex Virus", The Plant Cell, Sep. 1999, vol. 11, pp, 1665-1674.
Zuo et al., "Chemical-inducible systems for regulated expression of plant genes", Current Opinion Biotechnology, 2000, vol. 11, pp. 146-151.
Search Report mailed Nov. 24, 2011 from International Serial No. PCT/US2011/000885 filed May 17, 2011.
Office Action mailed Oct. 22, 2012 from U.S. Appl. No. 13/016,297, filed Jan. 28, 2013.
Office Action mailed Jun. 4, 2012 from United States U.S. Appl. No. 13/362,660, filed Jan. 31, 2012.
Office Action mailed Aug. 30, 2012 from U.S. Appl. No. 13/362,660, filed Jan. 31, 2012.
Notice of Allowance mailed Dec. 26, 2012 from United States U.S. Appl. No. 13/362,660, filed Jan. 31, 2012.
Notice of Allowance mailed Mar. 1, 2013 from U.S. Appl. No. 13/362,660, filed Jan. 31, 2012.

Boch et al., "Molecular Characterization of Three AVRBS3-Like Effectors From the Arabidopsis Pathogen Xanthomonas Campestris PV. Armoraciae," *XIV International Congress on Molecular Plant-Microbe Interactions*, Quebec City, Canada, Jul. 19-13, p. 41 (2009).
Bonas et al., "How Xanthomonas Manipulates the Cell," XIV International Congress On Molecular Plant-Microbe Interactions, Quebec City, Canada Jul. 19-13, p. 2-3 (2009).
Bonas et al., "Resistance in Tomato to Xanthomonas Campestris PV Vesicatoria Is Determined by Alleles of the Pepper-Specific Avirulence Gene AVRBS3,"Mol. Gen. Genet. 238:261-269 (1993).
Cermak et al.. "Efficient Design and Assembly of Custom Talen and Other Tal Effector-Based Constructs for DNA Targeting," *Nucleic Acids Research* epub doiL10.1093/nar/gkr218 (2011).
Guo et al., "Directed Evolution of Enhanced and Highly Efficient FokI Cleavage Domain for Zinc Finger Nucleases," *J. Mol. Biol.* 400:96-107 (2010).
Hahn et al., "New Mechanistic Insights Into the Virulene Activity of the Xanthomonas Type III Effector AVRBS3," XIV International Congress on Molecular Plant-Microbe Interactions, Quebec City, Canada, Jul. 19-13, p. 71 (2009).
Hummel et al., "Rice Gene Activation by Transcription Activator-Like Effectors of Xanthomonas Oryzae PVS. Oryzae and Oryzicola," XIV International Congress on Molecular Plant-Microbe Interactions, Quebec City, Canada, Jul. 19-13, p. 76 (2009).
Morbitzer et al.. "Regulation of Selected Genome Loci Using Denovoengineered Transcription Activator-Like Effector (Tale)-Type Transcription Factors," *PNAS* 107(50):21617-21622 (2010).
Schornak et al.. "Expression Levels of AVRBS3-Like Genes Affect Recognition Specificity in Tomoato BS4- But Not in Pepper BS3-Mediated Perception," *Mol. Plant Microbe Interact.* 18(11):1215-1225 (2005).
Stephens et al., "Dating the Origin of the CCR5-D32 Aids-Resistance Allele by the Coalescence of Haplotypes," *A. J. Human Gen.* 62:1507-1515 (1998).
Yu et al., "An Engineered VEGF-Activating Zinc Finger Protein Transcription Factor Improves Blood Flow and Limb-Salvage in Advanced-Age Mice," *Faseb Journal* 20:479-481 (2009).
Guan et al., "Heritable Endogenous Gene Regulation in Plants With Designed Polydactyl Zinc Finger Transcription Factors", Proceedings of the National Academy of Sciences USA Oct. 1, 2002, vol. 99, No. 20, pp. 13296-13301.
Handel et al., "Expanding or Restricting the Target Site Repertoire of Zinc-Finger Nucleases: The Inter-Domain Linker as a Major Determinant of Target Site Selectivity", Molecular Therapy, Jan. 2009, vol. 17, No. 1, pp. 104-111.
Hockemeyer et al., "Genetic engineering of human ES and iPS cells using TALE nucleases", Nature Biotechnology, 2011, vol. 29, No. 8, pp. 731-734.
Hopkins et al., "Identification of a Family of Avirulence Genes from Xanthomonas oryzae pv. oryzae", Molecular Plant-Microbe Interactions, 1992, vol. 5., No. 6, pp. 451-459.
Huang et al., "Heritable Gene Targeting in Zebrafish Using Customized TALENs", Nature Biotechnology, Aug. 2011, vol. 29, No. 8, pp. 699-700.
Hurt et al., "Highly specific zinc finger proteins obtained by directed domain shuffling and cell—based selection", Proceedings of the National Academy of Sciences USA, Oct. 14, 2003, vol. 100, No. 21, pp. 12271-12276.
Isalan et al., "A Rapid, Generally Applicable Method to Engineer Zinc Fingers Illustrated by Targeting the HIV-1 Promoter", Nature Biotechnology, Jul. 2001, vol. 19, pp. 656-660.
Jones et al., "The plant immune system", Nature, Nov. 16, 2006, vol. 444, pp. 323-329.
Kay et al., "Characterization of AvrBs3-Like Effectors from a Brassicaceae Pathogen Reveals Virulence and Avirulence Activities and a Protein with a Novel Repeat Architecture", Molecular Plant-Microbe Interactions, 2005, vol. 18, No. 8, pp. 838-848.
Kay et al., "Supporting Online Material for Bacterial Effector Acts as a Plant Transcription Factor and Induces a Cell Size Regulator", Science, Oct. 26, 2007, vol. 318, pp. 648-651, www.sciencemag.org/cgi/content/full/31815850/648/DCI.

(56) References Cited

OTHER PUBLICATIONS

Keshavarzi et al., "Basal Defences Induced in Pepper by Lipopolysaccharides Are Suppressed by Xanthomonas campestris pv. vesicatoria", Molecular Plant-Microbe Interactions, 2004, vol. 17, No. 7, pp. 805-815.
Kim et al., "Hybrid Restriction Enzymes: Zinc Finger Fusions to FokI Cleavage Domain", Proceedings of the National Academy of Sciences USA, Feb. 1996, vol. 93, pp. 1156-1160.
Kim et al., "Construction of a Z-DNA-Specific Restriction Endonuclease", Proceedings of the National Academy of Sciences USA, Nov. 1997, vol. 94, pp. 12875-12879.
Kim et al., "Site-Specific Cleavage of DNA-RNA Hybrids by Zinc Finger/FokI Cleavage Domain Fusions", Gene, 1997, vol. 203, pp. 43-49.
Knoop et al., "Expression of the Avirulence Gene avrBs3 from Xanthomonas campestris pv. vesicatoria Is Not Under the Control of hrp Genes and Is Independent of Plant Factors", Journal of Bacteriology, Nov. 1991, vol. 173, No. 22, pp. 7142-7150.
Ledford, "Plant genes get fine tailoring" Nature News, Published online Apr. 29, 2009, 3 pages, Retrieved from the Internet: <URL: http://www.nature.com/news/2009/090429/full/news.2009.415. html>.
Liu et al., "Design of Polydactyl Zinc-Finger Proteins for Unique Addressing Within Complex Genomes", Proceedings of the National Academy of Sciences USA, May 1997, vol. 94, pp. 5525-5530.
Mak, "Sequence-specific DNA-binding TALEs", Nature Biotechnology, Jan. 2011, vo. 29, No. 1, p. 43.
Marois et al., "The Xanthomonas Type III Effector Protein AvrBs3 Modulates Plant Gene Expression and Induces Cell Hypertrophy in the Susceptible Host", Molecular Plant-Microbe Interactions, 2002, vol. 15, No. 7, pp. 637-646.
Miller et al., "An improved zinc-finger nuclease architecture for highly specific genome editing", Nature Biotechnology, Jul. 2007, vol. 25, No. 7, pp. 778-785.
Minczuk et al., "Development of a single-chain, quasi-dimeric zinc-finger nuclease for the selective degradation of mutated human mitochondrial DNA", Nucleic Acids Research, 2008, vol. 36, No. 12, pp. 3926-3938.
Moore et al., "Transactivated and chemically inducible gene expression in plants", The Plant Journal, 2006, vol. 45, pp. 651-683.
Morbitzer et al., "Assembly of custom TALE-type DNA binding domains by modular cloning", Nucleic Acids Research, 2011, vol. 39, No. 13, pp. 5790-5799.
Murakami et al., 2010, "The repeat domain of the type III effector protein PthA shows a TPR-like structure and undergoes conformational changes upon DNA interaction", Proteins, vol. 78, pp. 3386-3395.
Mussolino et al., "A novel TALE nuclease scaffold enables high genome editing activity in combination with low toxicity", Nucleic Acids Research, 2011, vol. 39, No. 21 pp. 9283-9293, Published online Aug. 3, 2011.
Nakagawa et al., "Development of Series of Gateway Binary Vectors. pGWBs, for Realizing Efficient Construction of Fusion Genes for Plant Transformation", Journal of Bioscience and Bioengineering, 2007, vol. 104, No. 1, pp. 34-41
Nino-Liu et al., "Xanthomonas oryzae pathovars: model pathogens of a model crop", Molecular Plant Pathology, 2006, vol. 7, No. 5, pp. 303-324.
Nissan et al., "The type III effectors HsvG and HsvB of gall-forming Pantoea agglomerans determine host specificity and function as transcriptional activators", Molecular Microbiology, 2006, vol. 61, No. 5, pp. 1118-1131.
Noel et al., "XopC and XopJ, Two Novel Type III Effector Proteins From Xanthomonas campestris pv. vesicatoria", Journal of Bacteriology, 2003, vol. 185, No. 24, pp. 7092-7102.
Paques et al., "Meganucleases and DNA Double-Strand Break-Induced Recombintaion: Perspectives for Gene Therapy", Current Gene Therapy, 2007, vol. 7, pp. 49-66.
Park et al., "Avirulence Gene Diversity of Xanthomonas axonopodis pv. glycines Isolated in Korea", Journal of Microbiology Biotechnology. 2008, vol. 18, No. 9, pp. 1500-1509.
Pattanayak et al., "Revealing Off-Target Cleavage Specificities of Zinc-Finger Nucleases by In Vitro Selection", Nat. Methods, 2011, vol. 8, No. 9, pp. 765-770, available in PMC Mar. 1, 2012
Pavletich et al., "Zinc Finger-DNA Recognition: Crystal Structure of a Zif268-DNA Complex at 2.1 A", Science, May 10, 1991, vol. 252, pp. 809-817.
Pearson, "The Fate of Fingers", Nature, Sep. 11, 2008, vol. 455, pp. 160-164.
Pennisi, "The Tale of the TALES", Science, Dec. 14, 2012, vol. 338, pp. 1408-1411.
Pomerantz et al., (1995) "Structure-Based Design of Transcription Factors", Science, Jan. 6, 1995, vol. 267, pp. 93-96.
Porteus et al., "Chimeric Nucleases Stimulate Gene Targeting in Human Cells", Science, May 2, 2003, vol. 300, p. 763.
Porteus et al., "Gene Targeting Using Zinc Finger Nucleases", Nature Biotechnology, Aug. 2005, vol. 23, pp. 967-973.
Porteus, "Zinc fingers on target", Nature, May 21, 2009, vol. 459, pp. 337-338.
Puchta et al., "Homologous Recombination in Plant Cells is Enhanced by in vivo Induction of Double Strand Breaks into DNA by a Site-Specific Endonuclease", Nucleic Acids Research, 1993, vol. 21, No. 22, pp. 5034-5040.
Radecke et al., "Zinc-finger Nuclease-induced Gene Repair With Oligodeoxynucleotides: Wanted and Unwanted Target Locus Modifications", Molecular Therapy, Apr. 2010, vol. 18, No. 4, pp. 743-753.
Romer et al., "A single plant resistance gene promoter engineered to recognize multiple TAL effectors from disparate pathogens", Proceedings Of The National Academy Of Sciences, Dec. 1, 2009, vol. 106, No. 48, pp. 20526-20531.
Romero et al., "Temperature Sensitivity of the Hypersensitive Response of Bell Pepper to Xanthomonas axonopodis pv. vesicatoria", Phytopathology, 2002, vol. 92, No. 2, pp. 197-203.
Rossier et al., "HrpB2 and HrpF from Xanthomonas are type III-secreted proteins and essential for pathogenicity and recognition by the host plant", Molecular Microbiology, 2000, vol. 38, No. 4, pp. 828-838.
Rossier et al., "The Xanthomonas Hrp type III system secretes proteins from plant and mammalian bacterial pathogens", Proceedings of the National Academy of Sciences USA, Aug. 1999, vol. 96, pp. 9368-9373.
Rouet et al., "Expression of a Site-Specific Endonuclease Stimulates Homologous Recombination in Mammalian Cells", Proceedings of the National Academy of Sciences USA, Jun. 1994, vol. 91, pp. 6064-6068.
Rouet et al., "Introduction of Double-Strand Breaks into the Genome of Mouse Cells by Expression of a Rare-Cutting Endonuclease", Molecular and Cellular Bology, Dec. 1994, vol. 14, No. 12, pp. 8096-8106.
Schornack et al., "Expression Levels of avrBs3-Like Genes Affect Recognition Specificity in Tomato Bs4—But Not in Pepper Bs3—Mediated Perception", Molecular Plant-Microbe Interactions, 2005, vol. 18, No. 11, pp. 1215-1225.
Schornack et al., "The tomato resistance protein Bs4 is a predicted non-nuclear TIR-NB-LRR protein that mediates defense responses to severely truncated derivatives of AvrBs4 and overexpressed AvrBs3", The Plant Journal. 2003, 15 pages.
Segal et al., "Endonuclease-Induced, Targeted Homologous Extrachromosomal Recombination in Xenopus Oocytes", Proceedings of the National Academy of Sciences USA, Jan. 1995, vol. 92, pp. 806-810.
Buttner et al., "Getting across—bacterial type III effector proteins on their way to the plant cell", The EMBO Journal 2002, vol. 21, No. 20, pp. 5315-5322, Review.
Buttner et al., "Functional Analysis of HrpF, a Putative Type III Translocon Protein From Xanthomonas campestris pv. vesicatoria", Journal of Baccteriology, May 2002, vol. 184, No. 9, pp. 2389-2398.
Canteros et al., "A Gene From Xanthomonas campestris pv. vesicatoria That Determines Avirulence in Tomato is Related to avrBs3", Molecular Plant-Microbe Interactions, 1991, vol. 4, No. 6, pp. 628-632.

(56) References Cited

OTHER PUBLICATIONS

Carlson et al., "Targeting DNA With Fingers and TALENs", Molecular Therapy-Nucleic Acids, 2012, 1:e3; doi:10.1038/mtna.2011.5; published online Jan. 24, 2012.
Cathomen et al., "Zinc-Finger Nucleases: The Next Generation Emerges", Molecular Therapy, Jul. 2008, vol. 16, No. 7, pp. 1200-1207.
Chevalier et al., "Design, Activity and Structure of a Highly Specific Artificial Endonuclease", Molecular Cell, Oct. 2002, vol. 10, pp. 895-905.
Choo et al., "In vivo Repression by a Site-Specific DNA-Binding Protein Designed Against an Oncogenic Sequence", Nature, Dec. 15, 1994, vol. 372, pp. 642-645.
Choulika et al., "Induction of Homologous Recombination in Mammalian Chromosomes by Using the I-SceI System of Saccharomyces cerevisiae", Molecular and Cellular Biology, Apr. 1995, vol. 15, No. 4, pp. 1968-1973.
Christian et al., "Targeting DNA Double-Strand Breaks with TAL Effector Nucleases", Genetics, Oct. 2010, vol. 186, pp. 757-761, and Supporting Information Retrieved from the Internet: URL http://www.genetics.org/cgi/content/fulll/genetics.110.120717/DCI, 6 pages.
Cole et al., "The Jpred 3 secondary structure prediction server", Nucleic Acids Research, 2008, vol. 36, 5 pages, Web Server issue W197-W201.
De Feyter et al., "Gene-for-Genes Interactions Between Cotton R Genes and Xanthomonas campestris pv.malvacearum avr Genes", Molecular Plant-Microbe Interactions, 1993, vol. 6, No. 2, pp. 225-237.
DeFrancesco, "Move over ZFNs", Nature Biotechnology, Aug. 2011, vol. 29, No. 8, pp. 681-685.
Desjarlais et al., "Toward rules relating zinc finger protein sequences and DNA binding site preferences", Proceedings of the National Academy of Sciences USA, Aug. 1992, vol. 89, pp. 7345-7349.
Durai et al., "Zinc Finger Nucleases: Custom-Designed Molecular Scissors for Genome Engineering of Plant and Mammalian Cells", Nucleic Acids Research, 2005, vol. 33, No. 1, pp. 5978-5990.
Eisenschmidt et al., "Developing a programmed restriction endonuclease for highly specific DNA cleavage", Nucleic Acids Research, 2005, vol. 33, No. 22, pp. 7039-7047.
Engler et al., A One Pot, One Step, Precision Cloning Method with High Throughput Capability:, PLoS One, Nov. 2008, vol. 3, Issue 11, 7 pages, e3647.
Engler et al., "Golden Gate Shuffling: A One-Pot DNA Shuffling Method Based on Type IIs Restriction Enzymes", PLoS One, May 2009, vol. 4, Issue 5, 9 pages, e5553.
Fajardo-Sanchez et al., "Computer design of obligate heterodimer meganucleases allows efficient cutting of custom DNA sequences", Nucleic Acids Research, 2008, vol. 36, No. 7, pp. 2163-2173.
Foley, et al., "Rapid Mutation of Endogenous Zebrafish Genes Using Zinc Finger Nucleases Made by Oligomerized Pool ENngineering (OPEN)", PLoS One, Feb. 2009, vol. 4, Issue 2, 13 pages, e4348.
Fujikawa et al., "Suppression of Defense Response in Plants by the avrBs3/pthA Gene Family of Xanthomonas spp", Molecular Plant-Microbe Interactions, 2006, vol. 19, No. 3, pp. 342-349.
Gabriel et al., "An unbiased genome-wide analysis of zinc-finger nuclease specificity", Nature Biotechnology, Sep. 2011, vol. 29, No. 9, pp. 816-823.
GenBank Accession No. J04623, Apr. 26, 1993, 2 pages.
GenBank Accession No. M28828, Apr. 26, 1993, 4 pages.
GenBank Accession No. ACD58243, May 19, 2008, 2 pages.
Gen Bank Accession No. AY986492, Jun. 24, 2005, 2 pages.
GenBank Accession No. P14727, Jun. 28, 2011, 3 pages.
GenBank Accession No. X16130, Oct. 15, 2007, 3 pages.
GenBank Accession No. CP000967, GI: 188518722, May 19, 2008, 171 pages.
Gonchar et al., "PspXI, a novel restriction endoculease that recognizes the unusual DNA sequence S'-VC; TCBABG-3", Translated from Bulletin of biotechnology and physico-chemical biology named by Yu. A. Ovchinnikov, 2005, vol. 1, No. 1, 4 pages.
Gonzalez et al., "Molecular and Pathotypic Characterization of New Xanthomonas oryzae Strains from West Africa", Molecular Plant-Microbe Interactions, 2007, vol. 20, No. 5, pp. 534-546.
Greisman et al., "A General Strategy for Selecting High-Affinity Zinc Finger Proteins for Diverse DNA Target Sites", Science, Jan. 31, 1997, vol. 275, pp. 657-661.
Gu et al., "R gene expression induced by a type-III effector triggers disease resistance in rice", Nature, Jun. 23, 2005, vol. 435, pp. 1122-1125.
Al-Saadi et al., "All Five Host-Range Variants of Xanthomonas citri Carry One pthA Homolog with 17.5 Repeats That Determines Pathogenicity on Citrus, but None Determine Host-Range Variation", Molecular Plant-Microbe Interactions, 2007, vol. 20, No. 8, pp. 934-943, The American Phytopathological Society.
Alam et al., "Characterization of the cytotoxic effect of a chimeric restriction enzyme, H1°-FokI", Gene Therapy and Molecular Biology, 2006, vol. 10, pp. 147-160.
Alam, "Characterization of the cytotoxic effect of a novel chimeric restriction nuclease, H1°-FokI, in mouse fibroblast cells: Implications for chromatin mapping and gene therapy studies", Ph.D. Thesis, The University of Mississippi Medical Center, 2006, 227 pages.
Antony, "Molecular Basis of avrXa7 Mediated Virulence in Bacterial Blight of Rice" Kansas State University, Manhattan, Kansas, 2010, pp. 1-99.
Antony et al., "Rice xa13 Recessive Resistance to Bacterial Blight is Defeated by Induction of the Disease Susceptibility Gene Os-11N3", The Plant Cell, Nov. 2010; vol. 22, pp. 3864-3876, Epub Nov 23, 2010.
Arimondo et al., "Exploring the Cellular Activity of Camptothecin-Triple-Helix-Forming Oligonucleotide Conjugates", Molecular and Cellular Biology, Jan. 2006, vol. 26, No. 1, pp. 324-333.
Athinuwat et al., "Xanthomonas axonopodis pv. glycines Soybean Cultivar Virulence Specificity is Determined by avrBs3 Homolog avrXg1", Phytopathology, Aug. 2009; vol. 99, No. 8, pp. 996-1004.
Bai et al., "Xanthomonas oryzae pv. oryzae Avirulence Genes Contribute Differently and Specifically to Pathogen Aggressiveness", Molecular Plant-Microbe Interactions, 2000; vol. 13, No. 12, pp. 1322-1329
Ballvora et al., "Genetic Mapping and Functional Analysis of the Tomato Bs4 Locus Governing Recognition of the Xanthomonas campestris pv. vesicatoria AvrBs4 Protein", Molecular Plant-Microbe Interactions, May 2001; vol. 14, No. 5, pp. 629-638
Beretta et al., "Tethering a Type IB Topoisomerase to a DNA Site by Enzyme Fusion to a Heterologous Site-Selective DNA-Binding Protein Domain", Cancer Research, Aug. 1999, vol. 59, pp. 3689-3697.
Bibikova et al., "Enhancing Gene Targeting with Designed Zinc Finger Nucleases", Science, May 2, 2003, vol. 300, pp. 764.
Bibikova et al., "Stimulation of Homologous Recombination Through Targeted Cleavage By Chimeric Nucleases", Molecular and Cell Biology, Jan 2001, vol. 21, No. 1, pp. 289-297.
Boller et al., "Innate immunity in plants: an arms race between pattern recognition receptors in plants and effectors in microbial pathogens", Science, May 8, 2009, vol. 324, pp. 742-744.
Bonas et al., "How the bacterial plant pathogen Xanthomonas campestris pv. vesicatoria conquers the host", Molecular Plant Pathology, Jan. 2000, vol. 1, No. 1, pp. 73-76.
Borevitz et al., "Activation Tagging Identifies a Conserved MYB Regulator of Phenylpropanoid Biosynthesis", The Plant Cell, Dec. 2000, vol. 12, pp. 2383-2394.
Busk, "Regulatory elements in vivo in the promoter of the abscisic scid responsive gene rab17 from maize", The Plant Journal, 1997, vol. 11, pp. 1285-1295.
Buttner et al., "Targeting of two effector protein classes to the type III secretion system by a HpaC- and HpaB-dependent protein complex from Xanthomonas campestris pv. vesicatoria", Molecular Microbiology, 2006, vol. 59, No. 2, pp. 513-527.
Buttner et al., "HpaB from Xanthomonas campestris pv. vesicatoria acts as an exit control protein in type III-dependent protein secretion", Molecular Microbiology, 2004, vol. 54, No. 3, pp. 755-768.

* cited by examiner

N+136

VDLRTLGYSQQQEKIKPKVRSTVAQHHEALVGHGFTHAHIVALSQHPAALGTVAVKYQDMIAALPEA
THEAIVGVGKQWSGARALEALLTVAGELRGPPLQDTGQLLKIAKRGGVTAVEAVHAWRNALTGAPLN
LTPEQVVAIASNIGGKQALETVQRLLPVLCQAHGLTPEQVVAIASNGGKQALETVQRLLPVLCQAHGL
TPEQVVAIASNIGGKQALETVQRLLPVLCQAHGLTPEQVVAIASNGGKQALETVQRLLPVLCQAHGLT
TPAQVVAIASNIGGKQALETVQRLLPVLRQAHGLTPEQVVAIASNGGKQALETVQRLLPVLCQAHGLT
PAQVVAIASNIGGKQALETVQRLLPVLCQAHGLTPEQVVAIASHDGGKQALETVQRLLPVLCQAHGLT
PEQVVAIASHDGGKQALETVQRLLPVLCQAHGLTPDQVVAIASNGGKQALETVQRLLPVLCQAHGLT
PDQVVAIASNGGKQALETVQRLLPVLCQAHGLTPEQVVAIASHDGGKQALETVQRLLPVLCQAHGLT
PEQVVAIASNGGGRPALEⓢIVAQLSRPDPALAALTNDHLVALACLGGRPALDAVKKGLPHAPALIKRT
NRRIPERTSHRVADHAQVVRVLGFFQCHSHPAQAFDDAMTQFGMSRHGLLQLFRRVGVTELEARSGTL
PPASQRWDRILQASGMKRAKPSPTSTQTPDQASLHAFADSLERDLDAPSPTHEGDQRRASSRKRSRSD
RAVTGPSAQQSFEVRAPEQRDALHLPLSWRVKRPRTSIGGLPDPGTPTAADLAASSTVMREQDEDPF
AGAADDFPAFNEEELAWLMELLPQ

N+1
N-cap
C-cap
C+278

○ = C+1 position

FIGURE 1B

A (1-4)x binding sites ggtaccgagctcttacgcgtgctagcccgggctcgagatctgcatctcaattagtcagca
       NheI     BglII   SV40 promoter
accatagtcccgcccctaactccgcccatcccgcccctaactccgcccagttccgcccattctccg Ccccatcgctgactaattttttttattatgcagaggccgaggccgcctgagctattccag
          TATA box
Aagtagtgaggaggcttttttggaggcctaggcttttgcaaaaagcttggc.....*LUCIFERASE*

B

TR13    TATAAATACCTTCT

NheI (X)  SpeI          NheI  BglII

R13X2 Linker: CTAGTATAAATACCTTCTGCCTTACTAGTATAAATACCTTCTGCCTTGCTAGCTCGA

Figure 30
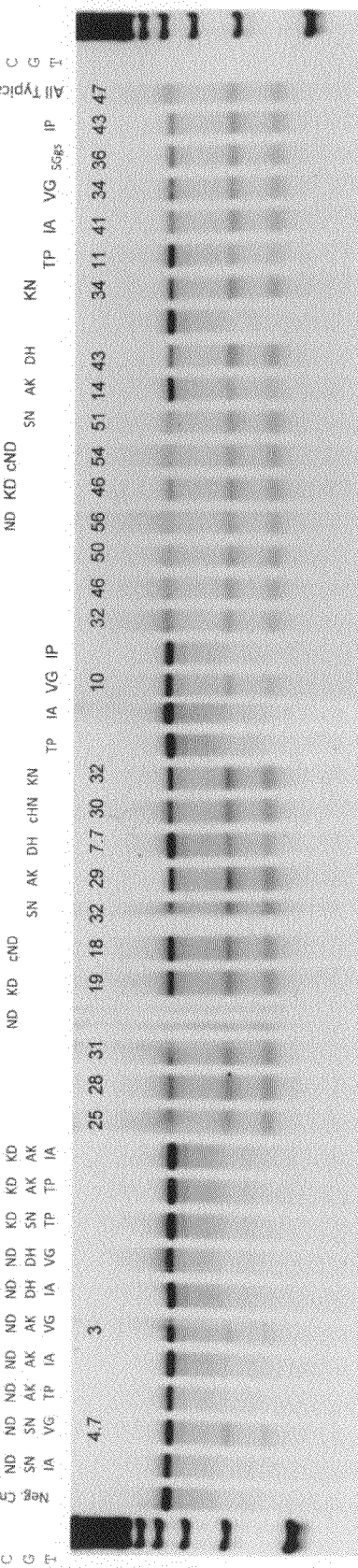
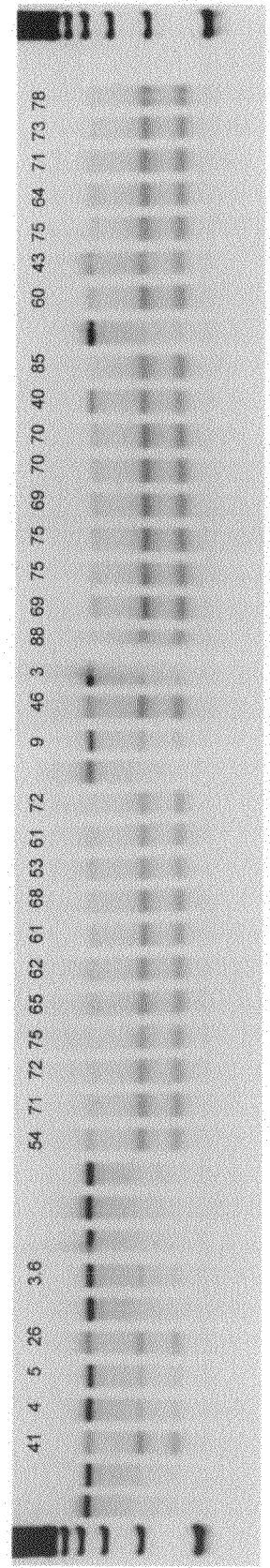

DNA-BINDING PROTEINS AND USES THEREOF

CROSS-REFERENCE TO RELATED APPLICATIONS

The present application claims the benefit of U.S. Provisional Application Nos. 61/395,836, filed May 17, 2010; 61/401,429, filed Aug. 12, 2010; 61/455,121, filed Oct. 13, 2010; 61/459,891, filed Dec. 20, 2010; 61/462,482, filed Feb. 2, 2011; 61/465,869, filed Mar. 24, 2011, the disclosures of which are hereby incorporated by reference in their entireties.

STATEMENT OF RIGHTS TO INVENTIONS MADE UNDER FEDERALLY SPONSORED RESEARCH

Not applicable.

FIELD OF THE INVENTION

The present invention provides methods for genetic modification and regulation of expression status of endogenous genes and other genomic loci using engineered DNA binding proteins.

BACKGROUND OF THE INVENTION

Many, perhaps most, physiological and pathophysiological processes can be controlled by the selective up or down regulation of gene expression. Examples of pathologies that might be controlled by selective regulation include the inappropriate expression of proinflammatory cytokines in rheumatoid arthritis, under-expression of the hepatic LDL receptor in hypercholesterolemia, over-expression of proangiogenic factors and under-expression of antiangiogenic factors in solid tumor growth, to name a few. In addition, pathogenic organisms such as viruses, bacteria, fungi, and protozoa could be controlled by altering gene expression of their host cell. Thus, there is a clear unmet need for therapeutic approaches that are simply able to up-regulate beneficial genes and down-regulate disease causing genes.

In addition, simple methods allowing the selective over- and under-expression of selected genes would be of great utility to the scientific community. Methods that permit the regulation of genes in cell model systems, transgenic animals and transgenic plants would find widespread use in academic laboratories, pharmaceutical companies, genomics companies and in the biotechnology industry.

Gene expression is normally controlled through alterations in the function of sequence specific DNA binding proteins called transcription factors. They act to influence the efficiency of formation or function of a transcription initiation complex at the promoter. Transcription factors can act in a positive fashion (activation) or in a negative fashion (repression).

Transcription factor function can be constitutive (always "on") or conditional. Conditional function can be imparted on a transcription factor by a variety of means, but the majority of these regulatory mechanisms depend of the sequestering of the factor in the cytoplasm and the inducible release and subsequent nuclear translocation, DNA binding and activation (or repression). Examples of transcription factors that function this way include progesterone receptors, sterol response element binding proteins (SREBPs) and NF-kappa B. There are examples of transcription factors that respond to phosphorylation or small molecule ligands by altering their ability to bind their cognate DNA recognition sequence (Hou et al., *Science* 256:1701 (1994); Gossen & Bujard, *Proc. Nat'l Acad Sci* 89:5547 (1992); Oligino et al., *Gene Ther.* 5:491-496 (1998); Wang et al., *Gene Ther.* 4:432-441 (1997); Neering et al., *Blood* 88:1147-1155 (1996); and Rendahl et al., *Nat. Biotechnol.* 16:757-761 (1998)).

Recombinant transcription factors comprising the DNA binding domains from zinc finger proteins ("ZFPs") have the ability to regulate gene expression of endogenous genes (see, e.g., U.S. Pat. Nos. 6,534,261; 6,599,692; 6,503,717; 6,689,558; 7,067,317; 7,262,054). Clinical trials using these engineered transcription factors containing zinc finger proteins have shown that these novel transcription factors are capable of treating various conditions. (see, e.g., Yu et al. (2006) *FASEB J.* 20:479-481).

Another major area of interest in genome biology, especially in light of the determination of the complete nucleotide sequences of a number of genomes, is the targeted alteration of genome sequences. Such targeted cleavage events can be used, for example, to induce targeted mutagenesis, induce targeted deletions of cellular DNA sequences, and facilitate targeted recombination at a predetermined chromosomal locus. See, for example, United States Patent Publications 20030232410; 20050208489; 20050026157; 20050064474; 20060188987; 2008015996, and International Publication WO 2007/014275, the disclosures of which are incorporated by reference in their entireties for all purposes. See, also, Santiago et al. (2008) *Proc Natl Acad Sci USA* 105:5809-5814; Perez et al. (2008) *Nat Biotechnol* 26:808-816 (2008).

Artificial nucleases, which link the cleavage domain of a nuclease to a designed DNA-binding protein (e.g., zinc-finger protein (ZFP) linked to a nuclease cleavage domain such as from FokI), have been used for targeted cleavage in eukaryotic cells. For example, zinc finger nuclease-mediated genome editing has been shown to modify the sequence of the human genome at a specific location by (1) creation of a double-strand break (DSB) in the genome of a living cell specifically at the target site for the desired modification, and by (2) allowing the natural mechanisms of DNA repair to "heal" this break.

To increase specificity, the cleavage event is induced using one or more pairs of custom-designed zinc finger nucleases that dimerize upon binding DNA to form a catalytically active nuclease complex. In addition, specificity has been further increased by using one or more pairs of zinc finger nucleases that include engineered cleavage half-domains that cleave double-stranded DNA only upon formation of a heterodimer. See, e.g., U.S. Patent Publication No. 20080131962, incorporated by reference herein in its entirety.

The double-stranded breaks (DSBs) created by artificial nucleases have been used, for example, to induce targeted mutagenesis, induce targeted deletions of cellular DNA sequences, and facilitate targeted recombination at a predetermined chromosomal locus. See, for example, United States Patent Publications 20030232410; 20050208489; 20050026157; 20050064474; 20060188987; 20060063231; 20070218528; 20070134796; 20080015164 and International Publication Nos. WO 07/014,275 and WO 2007/139982, the disclosures of which are incorporated by reference in their entireties for all purposes. Thus, the ability to generate a DSB at a target genomic location allows for genomic editing of any genome.

There are two major and distinct pathways to repair DSBs—homologous recombination and non-homologous end-joining (NHEJ). Homologous recombination requires the presence of a homologous sequence as a template (known as a "donor") to guide the cellular repair process and the results of the repair are error-free and predictable. In the absence of a template (or "donor") sequence for homologous recombination, the cell typically attempts to repair the DSB via the error-prone process of NHEJ.

The plant pathogenic bacteria of the genus *Xanthomonas* are known to cause many diseases in important crop plants. Pathogenicity of *Xanthomonas* depends on a conserved type III secretion (T3S) system which injects more than 25 different effector proteins into the plant cell. Among these injected proteins are transcription activator-like effectors ("TALE" or "TAL-effectors") which mimic plant transcriptional activators and manipulate the plant transcriptome (see Kay et al (2007) *Science* 318:648-651). These proteins contain a DNA binding domain and a transcriptional activation domain. One of the most well characterized TALEs is AvrBs3 from *Xanthomonas campestris* pv. *Vesicatoria* (see Bonas et al (1989) *Mol Gen Genet* 218: 127-136 and WO2010079430). TALEs contain a centralized repeat domain that mediates DNA recognition, with each repeat unit containing approximately 33-35 amino acids specifying one target base. TALEs also contain nuclear localization sequences and several acidic transcriptional activation domains (for a review see Schornack S, et al (2006) *J Plant Physiol* 163(3): 256-272). In addition, in the phytopathogenic bacteria *Ralstonia solanacearum* two genes, designated brg11 and hpx17 have been found that are homologous to the AvrBs3 family of *Xanthomonas* in the *R. solanacearum* biovar 1 strain GMI1000 and in the biovar 4 strain RS1000 (See Heuer et al (2007) *Appl and Envir Micro* 73(13): 4379-4384). These genes are 98.9% identical in nucleotide sequence to each other but differ by a deletion of 1,575 bp in the repeat domain of hpx17. However, both gene products have less than 40% sequence identity with AvrBs3 family proteins of *Xanthomonas*.

DNA-binding specificity of these TALEs depends on the sequences found in the tandem TALE repeat units. The repeated sequence comprises approximately 33-35 amino acids and the repeats are typically 91-100% homologous with each other (Bonas et al, ibid). There appears to be a one-to-one correspondence between the identity of the hypervariable diresidues at positions 12 and 13 with the identity of the contiguous nucleotides in the TALE's target sequence (see Moscou and Bogdanove, (2009) *Science* 326:1501 and Boch et al (2009) *Science* 326:1509-1512). These two adjacent amino acids are referred to as the Repeat Variable Diresidue (RVD). Experimentally, the natural code for DNA recognition of these TALEs has been determined such that an HD sequence at positions 12 and 13 leads to a binding to cytosine (C), NG binds to T, NI to A, NN binds to G or A, and NG binds to T. These specificity-determining TALE repeat units have been assembled into proteins with new combinations of the natural TALE repeat units and altered numbers of repeats, to make variant TALE proteins. When in their native architecture, these variants are able to interact with new sequences and activate the expression of a reporter gene in plant cells (Boch et al., ibid.). However, these proteins maintain the native (full-length) TALE protein architecture and only the number and identity of the TALE repeat units within the construct were varied. Entire or nearly entire TALE proteins have also been fused to a nuclease domain from the FokI protein to create a TALE-nuclease fusion protein ("TALEN"), and these TALENs have been shown to cleave an episomal reporter gene in yeast cells. (Christian et al. (2010) *Genetics* 186(2): 757-61; Li et al. (2011a) *Nucleic Acids Res.* 39(1):359-372). Such constructs could also modify endogenous genes in yeast cells to quantifiable levels and could modify endogenous genes in mammalian and plant cells to detectable, but unquantifiable levels when appropriate sequence amplification schemes are employed. See, Li et al. (2011b) *Nucleic Acids Res.* epub doi:10.1093/nar/gkr188; Cermak et al. (2011) *Nucleic Acids Res.* epub doi:10.1093/nar/gkr218. The fact that a two step enrichment scheme was required to detect activity in plant and animal cells indicates that fusions between nearly entire TALE proteins and the nuclease domain from the FokI protein do not efficiently modify endogenous genes in plant and animal cells. In other words, the peptide used in these studies to link the TALE repeat array to the FokI cleavage domain does not allow efficient cleavage by the FokI domain of endogenous genes in higher eukaryotes. These studies therefore highlight the need to develop compositions that can be used connect a TALE array with a nuclease domain that would allow for highly active cleavage in endogenous eukaryotic settings.

There remains a need for engineered DNA binding domains to increase the scope, specificity and usefulness of these binding proteins for a variety of applications including engineered transcription factors for regulation of endogenous genes in a variety of cell types and engineered nucleases that can be similarly used in numerous models, diagnostic and therapeutic systems, and all manner of genome engineering and editing applications.

SUMMARY OF THE INVENTION

The present invention thus provides for methods of targeted manipulation of expression state or sequence of endogenous loci. In some embodiments of the invention, the methods of the invention use DNA-binding proteins comprising one or more TALE-repeat units fused to functional protein domains (collectively "TALE-fusions"), to form engineered transcription factors, engineered nucleases ("TALENs"), recombinases, transposases, integrases, methylases, enzymatic domains and reporters. In some aspects, the polypeptide includes the at least one TALE repeat unit linked to additional TALE protein sequences, for efficient and specific function at endogenous target DNA. These additional sequences, which are linked to the N- and optionally the C-termini of the TALE repeat domain, are also referred to as the "N-cap" and "C-cap" sequences. Thus, the invention provides polypeptides comprising one or more (e.g., 1, 2, 3, 4, 5, 6, 7, 8, 9, 10, 11, 12, 13, 14, 15, 20 or more) TALE repeat and/or half-repeat units.

Thus, in one aspect, provided herein is a DNA-binding polypeptide comprising at least one TALE repeat unit (e.g., 1, 2, 3, 4, 5, 6, 7, 8, 9, 10, 11, 12, 13, 14, 15, 16, 17, 18, 19, 20 or more repeat unit(s)). The polypeptide typically includes an N-cap sequence (polypeptide) of any length that supports DNA-binding function of the TALE repeat(s) or functional activity of the TALE fusion protein. Optionally, the polypeptide may also include a C-cap sequence (polypeptide), for example a C-cap sequence of less than approximately 250 amino acids (C+230 C-cap; from residue C−20 to residue C+230). In addition, in certain embodiments, at least one of the TALE repeat units of the TALE polypeptides as described herein include repeat variable di-residue (RVD) regions that are atypical. The TALE repeat unit may be a wild-type domain isolated from *Xanthomonas*, *Ralstonia* or another related bacteria and/or may be engineered in some manner (e.g., may be non-naturally occurring). In certain embodiments, at least one TALE repeat unit is engineered (e.g., non-naturally occurring, atypical, codon optimized, combinations thereof, etc.). In certain embodiments, one or more amino acids in the TALE repeat domain (e.g., an RVD within one of the TALE repeats) are altered such that the domain binds to a selected target sequence (typically different from the target sequence bound by a naturally occurring TALE DNA binding domain). In other embodiments, at least one TALE repeat unit is modified at some or all of the amino acids at positions 4, 11, 12, 13 or 32 within the TALE repeat unit. In some embodiments; at least one TALE repeat unit is modified at 1 or more of the amino acids at positions 2, 3, 4, 11, 12, 13, 21, 23, 24, 25, 26, 27, 28, 30, 31, 32, 33, 34, or 35 within one TALE repeat unit. In other embodiments, the nucleic acid encoding the TALE repeat is modified such that the DNA sequence is altered but the amino acid sequence is not. In some embodiments, the DNA modification is for the purposes of codon optimization. In further embodiments, at least one TALE repeat unit is altered by combinations of the above described modifications. In some embodiments, TALE proteins comprising several modified TALE repeat units are provided. Combinations of naturally occurring and non-naturally occurring TALE repeat units are also provided. In a preferred embodiment, the TALE protein (wild-type or engineered) further comprises N-cap and optionally the C-cap sequences for efficient and specific function at endogenous target DNA. In some embodiments, the N-cap comprises residues N+1 to N+136 (see FIG. 1B for a description of the residue numbering scheme), or any fragment thereof. In other embodiments, the C-cap comprises residues C−20 to C+28, C−20 to C+39, C−20 to C+55, or C−20 to C+63 or any fragments of the full length TALE C-terminus thereof. In certain embodiments, the polypeptide comprising the TALE repeat domain, as well as an N-cap and optional C-cap sequences, further comprises a regulatory or functional domain, for example, a transcriptional activator, transcriptional repressor, nuclease, recombinase, transposase, integrase, methylase or the like.

Polynucleotides encoding these proteins are also provided as are pharmaceutical compositions. In addition, the invention includes host cells, cell lines and transgenic organisms (e.g., plants, fungi, animals) comprising these proteins/polynucleotides and/or modified by these proteins (e.g., genomic modification that is passed onto the progeny). Exemplary cells and cell lines include animal cells (e.g., mammalian, including human, cells such as stem cells), plant cells, bacterial cells, protozoan cells, fish cells, or fungal cells. In another embodiment, the cell is a mammalian cell. Methods of making and using these proteins and/or polynucleotides are also provided.

In one aspect, provided herein are fusion proteins comprising one or more engineered TALE repeat units, an N-cap, and an optional C-cap sequence, operatively linked to one or more heterologous polypeptide domains, for example functional (regulatory) domains. Libraries comprising modules of TALE repeats are provided as are optional structured or flexible linkers for connecting the engineered TALE repeats to the functional protein domain of interest. The functional protein domain (e.g., transcriptional activator, repressor, or nuclease) may be positioned at the C- or N-termini of the fusion protein. Methods of making fusion proteins as described herein are also provided.

The present invention also provides a method for identifying suitable target sequences (sites) for engineered TALE fusion proteins. In some embodiments, a target site identified has an increased number of guanine nucleotides ("G") as compared to a natural TALE target sequence. In other embodiments, the target does not require flanking thymidine nucleotides ("T"), as typical in naturally occurring TALE proteins. In some embodiments, the RVDs selected for use in the engineered TALE protein contains one or more NK (asparagine-lysine) RVDs for the recognition of G nucleotides in the target sequence. Additionally provided in this invention are novel (non-naturally occurring) RVDs, differing from those found in nature, which are capable of recognizing nucleotide bases. Non-limiting examples of atypical or non-naturally occurring RVDs (amino acid sequences at positions 12 and 13 of the TALE repeat unit) include RVDs as shown in Tables 27A 27B and 29, for example, VG and IA to recognize T, RG to recognize A and T, and AA to recognize A, C, and T are provided. Also provided are RVDs capable of interacting equally with all nucleotide bases (e.g. A, C, T, and G). Additional RVDs useful in the compositions and methods described herein are shown in Table 27.

Also provided by the invention are methods to constrain, or not constrain, by the user's choice, the distance or gap spacing between the two target sites on a nucleic acid that is subject to modification by a TALE-nuclease ("TALEN") heterodimer. In some embodiments, the gap spacing is constrained to 12-13 base pairs, while in other embodiments, the engineered TALEN is designed to cleave DNA targets comprising a gap spacing of between 12 to 21 base pairs. In some embodiments, the TALEN heterodimer is designed to cleave a sequence comprising a gap of between 1 and 34 nucleotides between each monomer binding site. In still more embodiments, the TALEN is constrained to cleave a target with a 12 or 13 base pair gap by utilizing a TALEN architecture comprising the +28 C-terminal truncation (C+28 C-cap). In other embodiments, the designed TALEN is made to cleave a target nucleic acid comprising a 12 to 21 base pair gap spacing using a TALEN architecture comprising the +63 C-terminal truncation, which increases the likelihood of being able to identify a suitable TALEN target site due to the flexibility in gap spacing requirements. In some embodiments, the TALEN has an engineered R1/2 repeat such that the R1/2 repeat is capable of targeting nucleotide bases other than T.

In another aspect, the present invention provides a vector for an engineered TALE DNA binding domain fusion wherein the vector comprises the TALE N-cap and C-cap sequences flanking the TALE repeat sequences as well as locations to allow for the cloning of multiple TALE repeat units, linker sequences, promoters, selectable markers, polyadenylation signal sites, functional protein domains and the like. Also provided by the invention herein is a method for the construction of a modular archive library including at least one TALE-repeat unit (e.g., engineered) for ready assembly of specific TALE DNA binding domain domains and fusion proteins comprising these domains (e.g., TALENs).

In yet another aspect, the present invention provides a method of modulating the expression of an endogenous cellular gene in a cell, the method comprising the step of: contacting a first target site in the endogenous cellular gene with a first engineered TALE fused to a functional domain (e.g., transcriptional modulator domain), thereby modulating expression of the endogenous cellular gene. In another aspect, the present invention provides a method of modulating expression of an endogenous cellular gene in a cell, the method comprising the step of: contacting a target site in the endogenous cellular gene with a fusion TALE protein wherein the TALE comprises an engineered TALE repeat domain such that the TALE has specificity for a desired sequence. In some embodiments, the modulatory effect is to activate the expression of the endogenous gene. In some embodiments, the expression of the endogenous gene is inhibited. In yet another embodiment, activation or repression of the endogenous gene is modulated by the binding of a TALE fusion protein such that an endogenous activator or repressor cannot bind to the regulator regions of the gene of interest.

In one embodiment, the step of contacting further comprises contacting a second target site in an endogenous cellular gene with a second engineered TALE fusion protein, thereby modulating expression of the second endogenous cellular gene. In another embodiment, the first and second target sites are adjacent. In certain embodiments, the first and second target sites are in different genes, for example to modulate expression of two or more genes using TALE-transcription factors. In other embodiments, the first and second target sites are in the same gene, for example when a pair of TALEN fusion proteins is used to cleave in the same gene. The first and second target sites are separated by any of base pairs ("gap size"), for example, 1 to 20 (or any number therebetween) or even more base pairs. In another embodiments, the step of contacting further comprises contacting more than two target sites. In certain embodiments, two sets of target sites are contacted by two pairs of TALENs, and are used to create a specific deletion or insertion at the two sets of targets. In another embodiment, the first TALE protein is a fusion protein comprising a regulatory or functional domain. In another, embodiment, the first TALE protein is a fusion protein comprising at least two regulatory or functional domains. In another embodiment, the first and second TALE proteins are fusion proteins, each comprising a regulatory domain. In another embodiment, the first and second TALE proteins are fusion proteins, each comprising at least two regulatory domains. The one or more functional domains may be fused to either (or both) ends of the TALE protein. Any of the TALE fusions proteins can be provided as polynucleotides encoding these proteins.

In yet another aspect, the invention provides compositions for C-caps linking a nuclease domain to a TALE repeat domain as described herein, wherein the resulting fusion protein exhibits highly active nuclease function. In some embodiments the C-cap comprises peptide sequence from native TALE C-terminal flanking sequence. In other embodiments, the C-cap comprises peptide sequence from a TALE repeat domain. In yet another embodiment, the C-cap comprises sequences not derived from TALE proteins. C-caps may also exhibit a chimeric structure, for example comprising peptide sequences from native TALE C-terminal flanking sequence and/or TALE repeat domains and/or non-TALE polypeptides.

In any of the compositions or methods described herein, the regulatory or functional domain may be selected from the group consisting of a transcriptional repressor, a transcriptional activator, a nuclease domain, a DNA methyl transferase, a protein acetyltransferase, a protein deacetylase, a protein methyltransferase, a protein deaminase, a protein kinase, and a protein phosphatase. In some aspects, the functional domain is an epigenetic regulator. In plants, such a TALE fusion can be removed by out-crossing using standard techniques. In such an embodiment, the fusion protein would comprise an epigenetic regulator such as, by non-limiting example, a histone methyltransferase, DNA methyltransferase, or histone deacetylase. See for example, co-owned U.S. Pat. No. 7,785,792.

Thus, in some aspects, the TALE fusion protein comprises a TALE-repeat domain fused to a nuclease domain (a "TALEN"). As noted above, in some embodiments the TALE repeat domain is further fused to an N-cap sequence and, optionally, a C-cap sequence. In other embodiments, the nuclease domain is connected to either the amino terminus of the N-cap or carboxy terminus of the C-cap via linker peptide sequences that provide efficient catalytic function of the nuclease domain. The nuclease domain may be naturally occurring or may be engineered or non-naturally occurring.

In some embodiments, the nuclease domain is derived from a Type IIS nuclease (e.g. FokI). In other embodiments, the TALE DNA binding domain is operably linked to a Bfi I nuclease domain. In some embodiments, the FokI domain is a single chain nuclease domain, comprising two cleavage half domains, and in others it is a FokI cleavage half domain. In some aspects of the invention, a single TALEN protein is used by itself to induce a double strand break in a target DNA, while in others, the TALEN is used as part of a pair of nucleases. In some embodiments, the pair comprises two TALENs comprising FokI half domains, wherein the pairing of the FokI half domains is required to achieve DNA cleavage, while in other cases the TALEN protein is used in combination with a zinc-finger nuclease wherein pairing of the two FokI cleavage domains is required to achieve DNA cleavage. In some embodiments, the TALE DNA binding domain is fused to a zinc finger to make a zin finger/TALE hybrid DNA binding domain. In some instances, the hybrid DNA binding domain is able to skip interacting with internal stretches of DNA bases within the DNA target binding site. In some embodiments, the FokI domains are able to form homodimers, and in other instances, heterodimerization of two non-identical FokI cleavage domains from each member of the TALEN pair is required for targeted cleavage activity. In these heterodimeric TALEN pairs, two FokI domains of the same type are not able to productively homodimerize. In other embodiments, a TALEN pair is used wherein one FokI cleavage domain is inactive such that pairing may occur, but the target DNA is nicked to produce a cut on one strand of the DNA molecule rather than cleaving both strands.

In any of the compositions or methods described herein, the TALE fusion protein may be encoded by a TALE fusion protein nucleic acid. In certain embodiments, the sequence encoding the TALE fusion protein is operably linked to a promoter. Thus, in certain embodiments, the methods of modulating endogenous gene expression or genomic modification further comprises the step of first administering the nucleic acid encoding the TALE protein to the cell. The TALE-fusion protein may be expressed from an expression vector such as a retroviral expression vector, an adenoviral expression vector, a DNA plasmid expression vector, or an AAV expression vector. In some embodiments, the expression vector is a lentiviral vector, and in some of these embodiments, the lentiviral vector is integrase-defective.

Also provided in the invention are TALENs (e.g., TALEN pairs) specific to any desired target locus (e.g., endogenous gene) in any cell type. Non-limiting examples include TALENs specific for NTF3, VEGF, CCR5, IL2Rγ, BAX, BAK, FUT8, GR, DHFR, CXCR4, GS, Rosa26, AAVS1 (PPP1R12C), MHC genes, PITX3, ben-1, Pou5F1 (OCT4), C1, RPD1, etc.

The TALE-repeat domains as described herein may bind to a target site that is upstream of, or adjacent to, a transcription initiation site of the endogenous cellular gene. Alternatively, the target site may be adjacent to an RNA polymerase pause site downstream of a transcription initiation site of the endogenous cellular gene. In still further embodiments, the TALE fusion protein (e.g., a TALEN) binds to a site within the coding sequence of a gene or in a non-coding sequence within or adjacent to the gene; such as for example, a leader sequence, trailer sequence or intron, or within a non-transcribed region, either upstream or downstream of the coding region.

In another aspect, described herein is a method for cleaving one or more genes of interest in a cell, the method comprising: (a) introducing, into the cell, one or more one or more TALEN protein(s) (or polynucleotides encoding the TALENs) that bind to a target site in the one or more genes under conditions such that the TALEN protein(s) is (are) expressed and the one or more genes are cleaved. In embodiments in which two or more TALEN proteins are introduced, one, some or all can be introduced as polynucleotides or as polypeptides. In some aspects, said gene cleavage results in the functional disruption of the targeted gene. Cleavage of the targeted DNA may be followed by NHEJ wherein small insertions or deletions (indels) are inserted at the site of cleavage: These indels then cause functional disruption through introduction of non-specific mutations at the cleavage location.

In yet another aspect, described herein is a method for introducing an exogenous sequence into the genome of a cell, the method comprising the steps of: (a) introducing, into the cell, one or more TALEN protein(s) (or polynucleotides encoding the TALEN protein(s)) that bind to a target site in a target gene under conditions such that the TALEN protein(s) is (are) expressed and the one or more target sites within the genes are cleaved; and (b) contacting the cell with an exogenous polynucleotide; such that cleavage of the DNA target site(s) stimulates integration of the exogenous polynucleotide into the genome by homologous recombination. In certain embodiments, the exogenous polynucleotide is integrated physically into the genome. In other embodiments, the exogenous polynucleotide is integrated into the genome by copying of the exogenous sequence into the host cell genome via specialized nucleic acid replication processes associated with homology-directed repair (HDR) of the double strand break. In yet other embodiments, integration into the genome occurs through non-homology dependent targeted integration (e.g. "end-capture"). In some embodiments, the exogenous polynucleotide comprises a recombinase recognition site (e.g. loxP or FLP) for recognition by a cognate recombinase (e.g. Cre or FRT, respectively). In certain embodiments, the exogenous sequence is integrated into the genome of a small animal (e.g. rabbit or rodent such as mouse, rat, etc.). In one embodiment, the TALE-fusion protein comprises a transposase, recombinase or integrase, wherein the TALE-repeat domain has been engineered to recognize a specifically desired target sequence. In some embodiments, TALE polypeptides are used. In some aspects, the TALE-fusion protein comprises a tranposase or integrase and is used for the development of a CHO-cell specific transposase/integrase system.

In some embodiments, the TALE-fusion protein comprises a methyltransferase wherein the TALE-repeat domain has been engineered to recognize a specifically desired target sequence. In some embodiments, the TALE-repeat domain is fused to a subunit of a protein complex that functions to effect epigenetic modification of the genome or of chromatin.

In yet further embodiments, that TALE-fusion further comprises a reporter or selection marker wherein the TALE-repeat domain has been engineered to recognize a specifically desired target sequence. In some aspects, the reporter is a fluorescent marker, while in other aspects, the reporter is an enzyme.

In another aspect, described herein are compositions comprising one or more of the TALE-fusion proteins. In certain embodiments, the composition comprises one or more TALE-fusion proteins in combination with a pharmaceutically acceptable excipient. In some embodiments, the composition comprises a polynucleotide encoding the TALE fusion protein. Some embodiments comprise a composition comprising a DNA molecule encoding a TALEN. In other embodiments, the composition comprises a RNA molecule encoding a TALEN. Some compositions further comprise a nucleic acid donor molecule.

In another aspect, described herein is a polynucleotide encoding one or more TALE-fusion proteins described herein. The polynucleotide may be, for example, mRNA.

In another aspect, described herein is a TALE-fusion protein expression vector comprising a polynucleotide, encoding one or more TALE-fusion proteins described herein, operably linked to a promoter (e.g., constitutive, inducible, tissue-specific or the like).

In another aspect, described herein is a host cell comprising one or more TALE-fusion proteins and/or one or more polynucleotides (e.g., expression vectors encoding TALE-fusion proteins as described herein. In certain embodiments, the host cell further comprises one or more zinc finger proteins and/or ZFP encoding vectors. The host cell may be stably transformed or transiently transfected or a combination thereof with one or more of these protein expression vectors. In other embodiments, the one or more protein expression vectors express one or fusion proteins in the host cell. In another embodiment, the host cell may further comprise an exogenous polynucleotide donor sequence. Any prokaryotic or eukaryotic host cells can be employed, including, but not limited to, bacterial, plant, fish, yeast, algae, insect, worm or mammalian cells. In some embodiments, the host cell is a plant cell. In other aspects, the host cell is part of a plant tissue such as the vegetative parts of the plant, storage organs, fruit, flower and/or seed tissues. In further embodiments, the host cell is an algae cell. In other embodiments, the host cell is a fibroblast. In any of the embodiments, described herein, the host cell may comprise a stem cell, for example an embryonic stem cell. The stem cell may be a mammalian stem cell, for example, a hematopoietic stem cell, a mesenchymal stem cell, an embryonic stem cell, a neuronal stem cell, a muscle stem cell, a liver stem cell, a skin stem cell, an induced pluripotent stem cell and/or combinations thereof. In certain embodiments, the stem cell is a human induced pluripotent stem cells (hiPSC) or a human embryonic stem cell (hESC). In any of the embodiments, described herein, the host cell can comprise an embryo cell, for example one or more mouse, rat, rabbit or other mammal cell embryos. In some aspects, stem cells or embryo cells are used in the development of transgenic animals, including for example animals with TALE-mediated genomic modifications that are integrated into the germline such that the mutations are heritable. In further aspects, these transgenic animals are used for research purposes, i.e. mice, rats, rabbits; while in other aspects, the transgenic animals are livestock animals, i.e. cows, chickens, pigs, sheep etc. In still further aspects, the transgenic animals are those used for therapeutic purposes, i.e. goats, cows, chickens, pigs; and in other aspects, the transgenic animals are companion animals, i.e. cats, dogs, horses, birds or fish.

Another aspect provided by the invention is a method for identifying a suitable nucleic acid target for TALE binding. In some embodiments, a target is chosen based upon its similarity to target sites used by typical, naturally occurring TALE proteins. In other embodiments, a target is selected that is not utilized by typical, naturally occurring TALE proteins because the engineered TALE proteins have been altered in such a way as to make them able to interact with an atypical, target sequence. In some embodiments, this alteration involves the selection of atypical (non-naturally occurring or rare) RVD sequences. In further embodiments, the atypical RVD used is a 'NK' RVD for the recognition of a G residue in the desired target sequence. In other embodiments, targets are selected that contain non-natural ratios of nucleic acid bases because the engineered TALE proteins have been altered in such a way as to make them able to interact with a non-natural ratio of nucleic acid bases. In some embodiments, the ratio of bases in the desired target sequence comprises an unusual number of G residues. In other embodiments, the ratio of bases in the desired target sequence comprises an unusual number of atypical di-nucleotides, tri-nucleotides or tetra-nucleotides. Further provided are design rules for identifying the most optimal targets for TALE-DNA binding interactions. These rules provide guidance on selection of a target site sequence comprising optimal di- and tri-nucleotide pairs. In addition, these rules also provide guidance on less optimal di- and tri-nucleotide pairs so that the artisan may avoid these sequences if desired. Also provided are RVDs able to interact with all nucleotides to provide the user a greater flexibility in choosing target sequences.

In one aspect, the invention provides compositions and methods for in vivo genomic manipulation. In certain embodiments, mRNAs encoding TALENs may be injected into gonads, ovum or embryos for introducing specific DSBs as desired. In some embodiments, donor nucleotides are co-delivered with the TALEN mRNAs to cause specific targeted integration in the organism.

In yet a further aspect, provided herein are kits comprising the TALE-domain proteins (and fusion proteins comprising these TALE-repeat proteins) of the invention. These kits may be used to facilitate genomic manipulation by the user and so can provide a TALEN, for example, that will cleave a desired target or a safe harbor locus within a genome. The TALEN may be provided either as nucleic acid (e.g. DNA or RNA) or may be provided as protein. In some instances, the protein may be formulated to increase stability, or may be provided in a dried form. In some instances, the kits are used for diagnostic purposes. In some instances, the TALE-fusion included in the kit is a transcriptional regulator. In some instances, the TALE-fusion comprises a reporter.

BRIEF DESCRIPTION OF THE DRAWINGS

FIG. 1, panels A and B, depict a TALE protein. FIG. 1B (SEQ ID NO:135) shows the primary sequence of a cloned natural TALE protein (hereinafter referred to as "TALE13") that was isolated with a cloning scheme designed to delete the N-terminal 1-152 amino acid residues. The N-cap and C-cap are indicated by a thick black line below the sequence; positions N+1 and N+136 in the N-cap and positions C+1 and C+278 in the C-cap are indicated. The half repeat is the first 20 residues of the C-cap and ends immediately prior to the position indicated as "C+1". Underlined residues in the TALE repeats and half repeat indicate amino acids (RVDs) that specify the DNA nucleotide contacted by the repeat during target binding.

FIG. 2, panels A and B, show the reporter construct for use with the predicted target of TALE13 (TR13). FIG. 2A (SEQ ID NO:136) shows a schematic of the reporter vector indicating the cloning sites used for inserting 1-4 TR13 targets into the vector. The region in italics is the promoter region for the luciferase gene. FIG. 2B (SEQ ID NOS 547 and 137, respectively, in order of appearance) shows the linker sequence used containing two TR13 targets.

FIG. 4A is a schematic of the TALE proteins, with or without the addition of VP16 domain, as well as the reporter constructs used in the study. R13x2 indicates the construct where two of the TALE13 (TR13) targets are inserted while R15x2 indicates the construct where two of the TALE15 (TR15) targets are inserted. FIG. 4B shows the reporter gene activation by TALE protein with the VP16 fusion but not by the TALE protein itself. Thus, the natural transcriptional activation domain present in the TALE protein was not functional in mammalian cells in this assay. Moreover, the transcriptional activity observed was specific as the reporter gene activation occurs only when the correct targets are matched with their corresponding TALE VP16 fusions. The cloned TALE13 and TALE15 are indicated as TR13 and TR15 respectively. TR13-VP16 and TR15-VP16 are similar to TR13 and TR15 with the additional VP16 activation domain fused to their C-terminus.

FIG. 5A shows a schematic of the reporter constructs where the target sequences are placed either proximal (R13x4) or distal (R13x4D) to the SV40 promoter. FIG. 5B shows the reporter gene activation by the indicated TALEs. "nR13V-d145C" refers to an expression construct containing the SV40 nuclear localization sequence, the TR13 sequence with 145 amino acid residues deleted from the C-terminus (yielding a C+133 C-cap) and the VP16 activation domain, whereas "R13-VP16" refers to an expression construct containing TALE13 sequence and the VP16 activation domain. As shown, (i) the C-terminal 145 amino acids of the full length TALEs are not required for the reporter gene activation, and (ii) the reporter gene activation is greatest when the target sequences are placed proximal to the promoter sequence.

FIG. 6A depicts the activation of a reporter gene using a fusion protein comprising the engineered TALE 18 protein (R23570 here; referred to as NT-L in later figures). The reporter construct contains 2 copies of the engineered TALE18 targets upstream from the luciferase gene. Activation of this reporter is observed only with R23570V, which contains the 17.5 engineered repeat sequences (17 full TALE repeats and one half repeat), the N- and C-terminal sequences (N-cap and C-cap) flanking the tandem TALE repeats of TR13, and the VP16 activation domain. Deletion of both the N- and C-terminal flanking sequences (N-cap and C-cap) abolishes the activity (compare nR23570S-dNC to mock). nR23570S-dNC contains the SV40 NLS (n), the 17.5 engineered TALE repeat sequences, fused to a single p65 activation domain (S), but is lacking the N- and C-terminal sequences (N-cap and C-cap) from TALE (dNC). The nR23570SS-dNC is the same as nR23570S-dNC except that it has two p65 domains. The R0-VP16 construct is the same as R23570 but lacks the tandem TALE repeats. 'Mock' shows the results for an experiment lacking an expression construct. FIG. 6B depicts the activation of an endogenous gene in its chromosomal environment by a fusion protein comprising the engineered (non-naturally occurring) TALE18 domain. The engineered TALE18 (R23570V), which is designed to target to the NTF3 gene, can lead to a substantial increase in the endogenous NTF3 mRNA level. Under the same conditions, the expression of NTF3 mRNA is not affected by either R0-VP16 or GFP. R23570V and R0-VP16 are described as above.

FIG. 7A depicts a diagram of the exemplary proteins and their target in the NTF3 promoter (SEQ ID NO:138). The two TALE transcription factor variants were linked to the VP16 activation domain and expressed in HEK293 cells. The sequence at the bottom shows the promoter-proximal region of human NTF3. Underlined bases indicate the target site for the NT-L TALE repeat domain. The hooked arrow shows the start site of NTF3 transcription. FIG. 7B shows relative NTF3 mRNA levels in HEK293 cells expressing either the top or lower protein sketched in FIG. 7A. "eGFP" indicates cells transfected with a control plasmid that expresses enhanced GFP. Measurements were performed in quadruplicate and error bars indicate standard deviations. FIG. 7C depicts levels of NTF3 protein secreted from HEK293 cells expressing either the top or lower proteins sketched in 7A. Measurements were performed in duplicate using an ELISA assay, and error bars indicate standard deviations. "Neg." indicates cells transfected with an empty vector control. FIG. 7D shows the RVDs (top row of letters), expected binding site (second row of letters (SEQ ID NO: 548)) and SELEX-derived base frequency matrix for NT-L (graph at bottom). Except for the first and fifth positions in the matrix, the most frequently selected base matches the target locus sequence.

FIG. 8A depicts the data for an NT3-specific TALE DNA binding domain comprising 9.5 TALE repeats, while FIG. 8B depicts the data for a VEGF-specific TALE DNA binding domain comprising 9.5 TALE repeats. For both sets of data, when the N-terminal truncations were made, the C-terminus was maintained at the C+95 position while for the C-terminal truncations, the N-terminus was maintained at the N+137 position (these constructs have a methionine residue appended to the N+136 N-cap residue). As can be seen, both proteins showed an apparent decrease in relative DNA binding affinity under the conditions of this assay when the protein was truncated on the N-terminus further than the N+134 position. Additionally, both proteins showed an apparent decrease in relative DNA binding affinity under the conditions of this assay when the C-terminus was truncated past amino acid C+54.

In FIG. 9A, the data for the NTF3-specific TALE DNA binding domain is shown, but in this case, when the N-terminal truncations were being tested, the C-terminus was maintained at the C+54 position. For the C-terminal truncations, the N-terminal amino acid was the N+134 position. In FIG. 9B, the data for the VEGF-specific TALE DNA binding domains is shown. As shown, the N- and C-terminal ends were maintained as described above for FIG. 9A.

FIG. 11A depicts a schematic of a single stranded annealing based reporter assay (SSA) for detecting the nuclease activity in mammalian cells. The reporter construct (SSA-R13) in this assay contained the TALE13 target, sandwiched by the N-terminal (GF) and C-terminal part (FP) of the GFP coding sequence. The plasmid SSA-R13 by itself cannot drive the GFP expression, but the cleavage of the R13 target promotes homologous recombination between the N-terminal (GF) and C-terminal (FP) part of the GFP to form a functional GFP. Thus, the nuclease activity of TALEN protein was assessed by analyzing the percentage of the GFP positive cells. FIG. 11B demonstrates nuclease activity by a TALEN protein. The GFP positive cells generated from SSA-R13 reporter construct increased significantly using a TALEN (R13d182C-scFokI; C+95 C-cap), compared to a control experiment lacking the nuclease plasmid (mock). R13d182C-scFokI is the same as R13V-d182C described above except that two copies of FokI domain, linked by 12 copies of GGGGS (SEQ ID NO: 124) sequences between the FokI domains, is used to replace the VP16 activation domain.

FIG. 15A (SEQ ID NOS 342 and 452, respectively, in order of appearance) depicts the target sequence used in the reporter plasmid for the NTF3 targeting TALE pairs which also includes binding sites for a pair of CCR5-specific ZFNs (8267/8196). FIG. 15B is a graph depicting the results of the SSA nuclease assay where (−)NT3 R18 C28L8 (light gray bars; C+28 C-cap, L8 linker) depicts data observed when only one member of the NTF3-specific pair was present while (+)NT3 R18 C28L8 (dark gray bars) depicts the results when both members of the pair were present. "8267EL8196KK" indicates the results using the CCR5-specific ZFN pair.

FIG. 17A shows the SELEX specificity data for the engineered TALEN protein designated NT-R which is the engineered partner made for the NT-L TALEN fusion. The expected bases and corresponding RVDs are shown above the plot. The +63 C-terminal flanking region was used for this SELEX experiment. FIG. 17B shows a gel of the results of a Cel-I assay using four NTF3-specific TALEN pairs in K562 cells where the culture conditions were either at 30° C. or 37° C. As can be seen from the data presented, the most active pair demonstrated gene modification levels of 3% at 37° C. and 9% under cold-shock conditions (30° C.) (Doyon et al. (2010) *Nat Methods* 8(1):74-9. Epub 2010 Dec. 5 and U.S. Publication No. 2011-0129898. 84 amplicons from the PCR pool from the cold-shock study were then sequenced, and seven mutated alleles were identified, which are shown in FIG. 17C (SEQ ID NO:343-350). As can be seen, small indels are observed.

FIG. 18, panels A and B, depict the sequencing results observed following endogenous cleavage of the NTF3 locus in K562 cells using TALENs. FIG. 18A depicts the chromosomal sequence (SEQ ID NO:139-140) and the boxes delineate the binding sites for the two TALENs. FIG. 18B depicts a compilation of sequencing results of the NTF3 locus from cells treated with the different NTF3 TALEN pairs described in Example 8 aligned with the wild-type ("wt") sequence (SEQ ID NO:141-175).

FIG. 20A shows part of the NTF3 target locus (top duplex, SEQ ID NOS 351 And 550, respectively, in order of appearance) and one of the oligonucleotide duplexes used for this study (bottom duplex, SEQ ID NOS 352 and 551, respectively, in order of appearance). Binding sites for NT-L+28 and NT-R+63 are underlined in the top sequence. The cleavage overhang that will most efficiently capture the duplex (5' CTGG) is also highlighted. FIG. 20B shows part of the NTF3 target locus (top duplex, SEQ ID NOS 353 and 552, respectively, in order of appearance) and the second oligonucleotide duplex used for this study (bottom sequences, SEQ ID NOS 354 and 553, respectively, in order of appearance). Binding sites for NT-L+28 and NT-R+63 are underlined in the top sequence. The cleavage overhang that will most efficiently capture this second duplex (5' TGGT) is also shown. FIG. 20C (SEQ ID NO:355-357) shows results following expression of NT-L+28 and NT-R+63 in K562 cells in the presence of the oligonucleotide duplex shown in FIG. 20A. Junctions between successfully integrated duplex and genomic DNA were then amplified using one primer that anneals within the duplex and one primer that anneals to the native NTF3 locus. The resulting amplicons were cloned and sequenced. The "expected" sequence at top indicates the sequence that would result from a perfect ligation of oligonucleotide duplex to the cleaved locus. The box highlights the location of the duplex overhang in the junction sequences. The bottom two lines provide junction sequences obtained from this study. As shown, eleven junction sequences resulted from perfect ligation of duplex to the cleavage overhang, while one junction sequence exhibited a short deletion (12 bp) consistent with resection prior to repair by NHEJ. FIG. 20D (SEQ ID NO:358-362) shows results from experiments as shown in FIG. 20C except that the oligonucleotide duplex shown in FIG. 20B was used, which has a 4 bp overhang that is shifted by one base relative to the duplex shown in FIG. 20A. The lowest four lines provide junction sequences obtained from this study. As shown, four distinct sequences were identified, which each exhibit short deletions consistent with resection prior to NHEJ-mediated repair.

FIG. 21 discloses SEQ ID NO: 131.

NG* (where the asterisk indicates the RVD was observed in a 33-residue TALE repeat instead of the more typical 34-residue repeat). 15 other RVD sequences were observed in this sample, but these all had frequencies below 1%.

Figure 23:
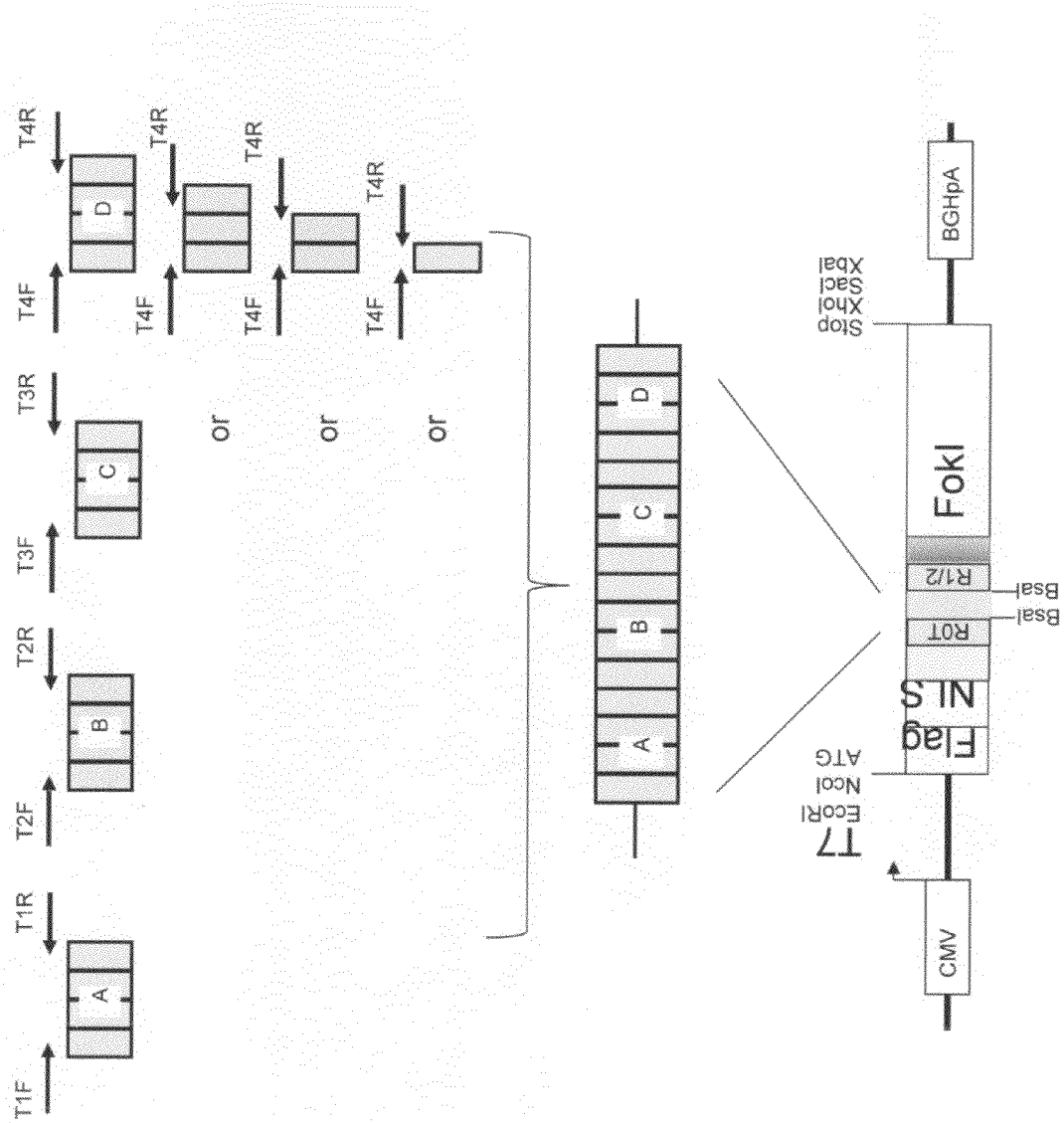

FIG. 23 depicts a schematic of the method used to tandemly link PCR amplicons of selected TALE repeat modules and ligate them into a vector backbone to create the desired TALE fusion protein. Specific primers are listed in Example 11. Also depicted is the vector backbone into which the assembled TALE fusion is cloned. The fusion partner domain is a FokI nuclease catalytic domain to allow production of one member of a TALEN pair.

Figure 24:
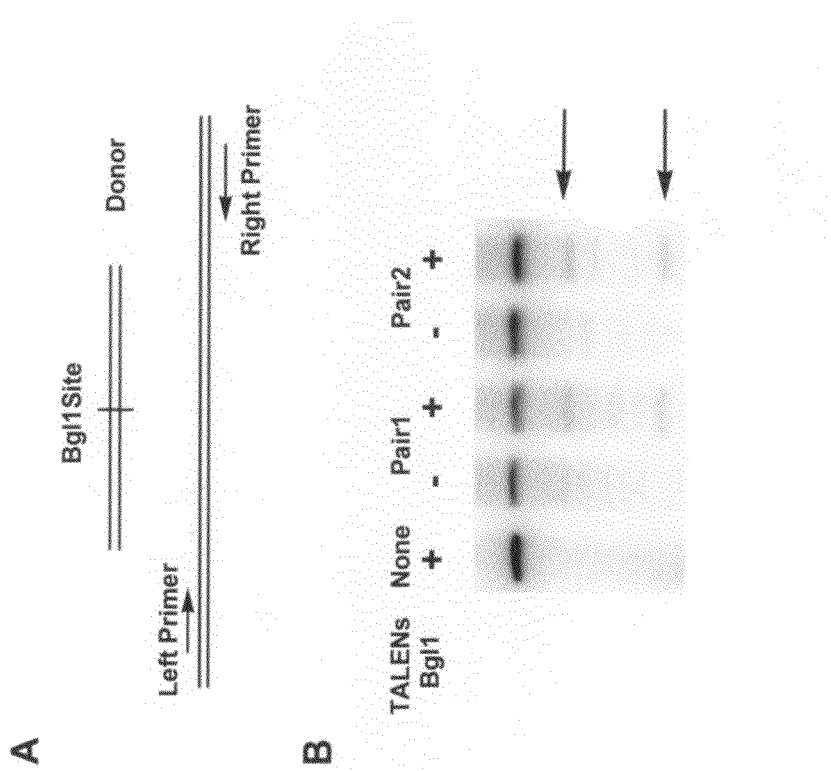

FIG. 24, panels A and B, depict the use of TALENs to drive homology-based transfer of a short segment of heterology encoding a RFLP into the endogenous CCR5 locus. FIG. 24A shows a schematic for the assay, and depicts the location of the PCR primers used and the BglI site. FIG. 24B depicts a gel showing insertion of a 46 bp donor sequence into a DSB introduced by a CCR5-specific TALEN pair. The donor sequence contains a unique BglI restriction site, so upon PCR amplification of the target site and then digestion of the PCR product with BglI, sequences that have been cleaved by the TALEN pair and have had insertion of the 46 bp donor sequence will have two BglI cleavage products, as indicated in the Figure.

Figure 25:
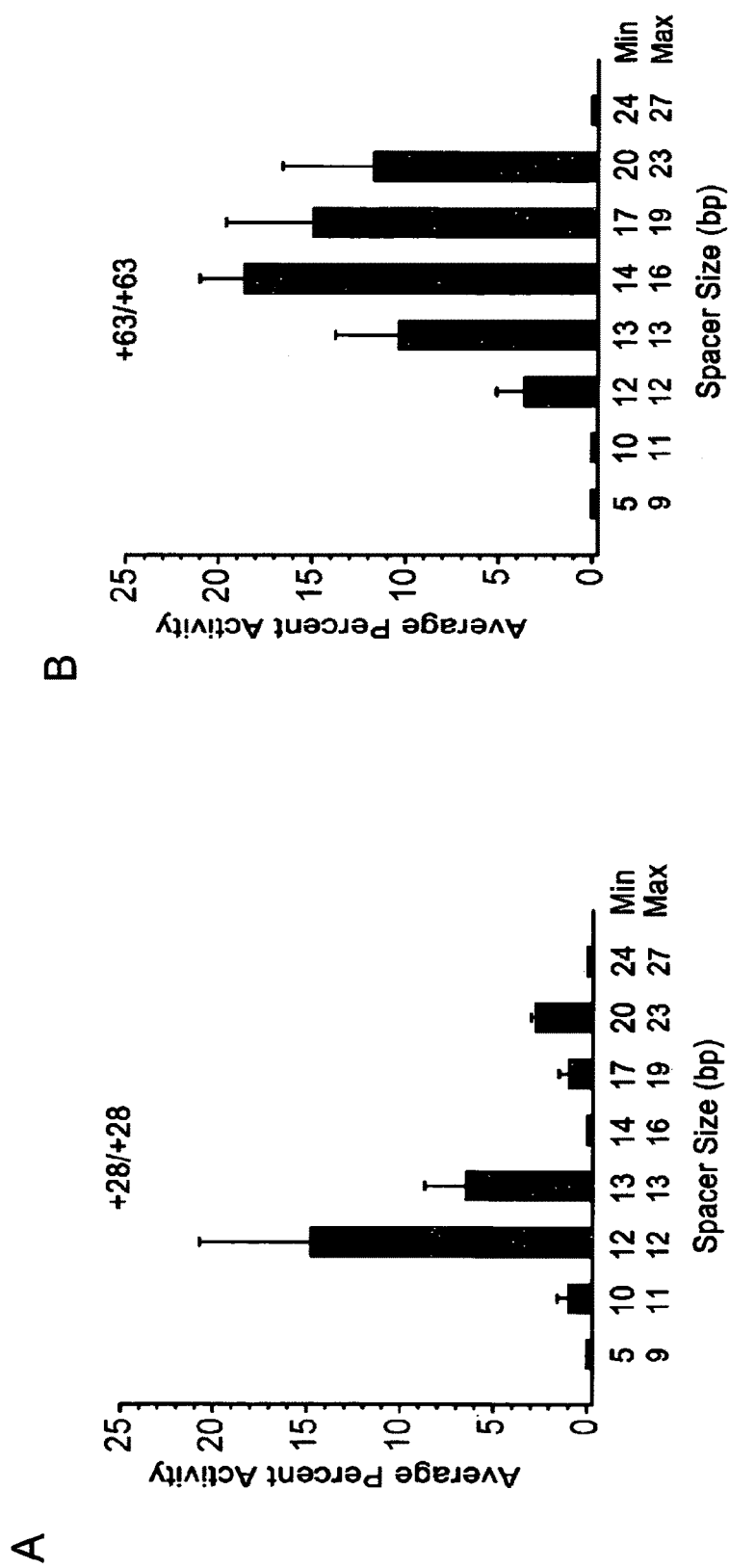

FIG. 25, panels A and B, are graphs depicting the cleavage efficacy of TALENs as compared to target gap spacings. FIG. 25A depicts the activity of a panel of CCR5-specific TALEN pair with a +28/+28 pairing (C+28 C-cap on both TALENs) while FIG. 25B depicts the activity of a panel CCR5-specific TALEN pair comprising a +63/+63 pairing (C+63 C-cap on both TALENs). As can be seen, the activity of the +28/+28 pair is more tightly constrained to a 12 or 13 bp gap spacing between the two target sequences while the +63/+63 pair exhibits activity across a gap spacing range of 12-23 bp.

Figure 26:
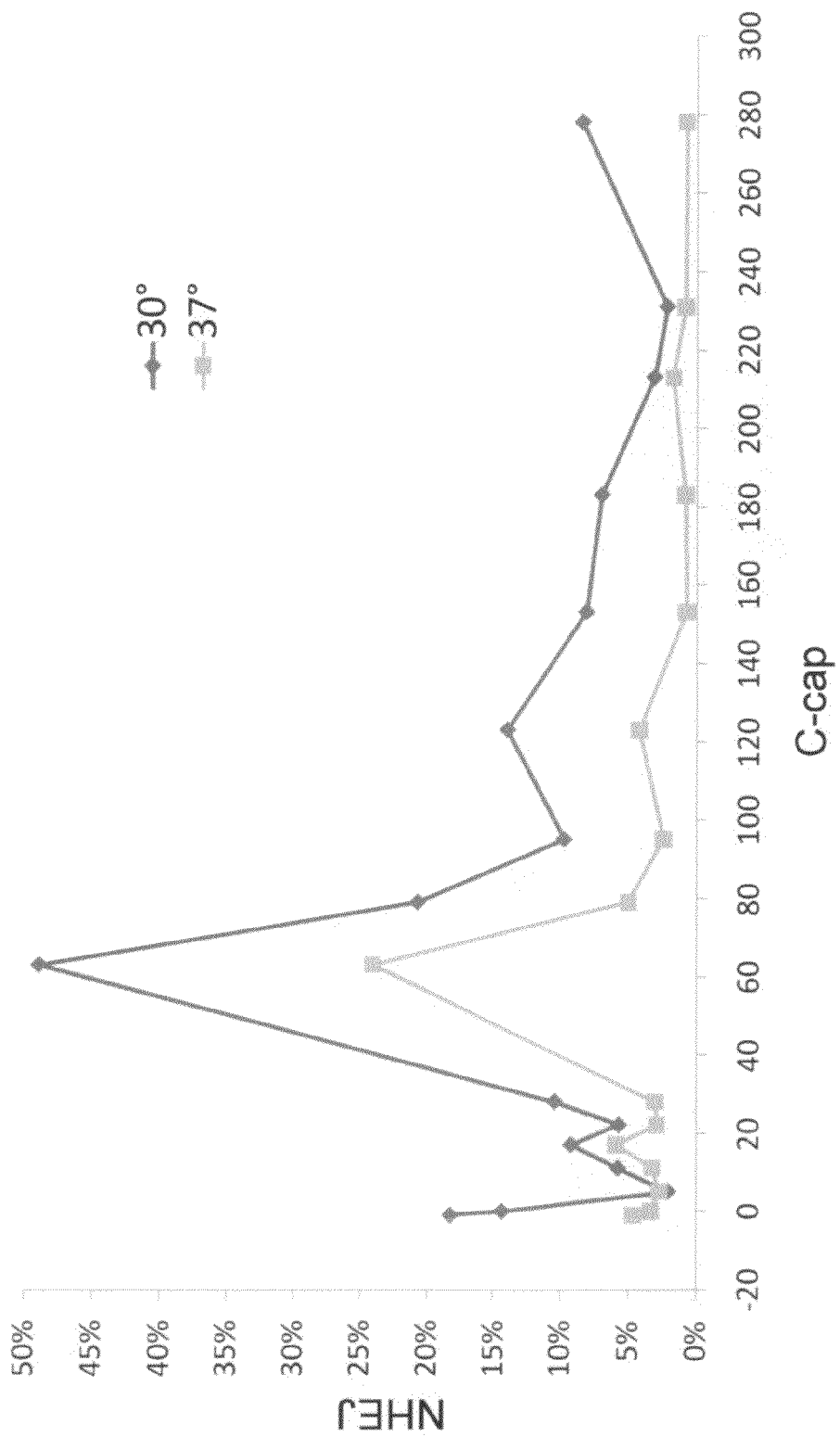

FIG. 26 is a graph depicting the endogenous activity of a CCR5-specific TALEN pair with different length C-cap sequences, or stated another way, different sequences linking the array of full TALE repeats to the nuclease domain. C terminal truncations were made across the C-terminal sequence to yield C-caps from C-2 to C+278. These constructs were tested for TALEN activity in K562 cells against an endogenous target with an 18 bp gap spacing where the cells were incubated at either 37° C. (light squares) or cold shock conditions (30° C., dark diamonds). The activity was highly dependent on the identity of the sequence used to connect the array of full TALE repeats with the FokI cleavage domain. Note that our C-cap notation does not include C+0 so the C−1 C-cap value was plotted at X=0 and C−2 was plotted as X=−1. C+5, C+28, etc. were plotted as X=5, X=28, etc. Peak activity was observed for a C+63 C-cap sequence.

Figure 27:
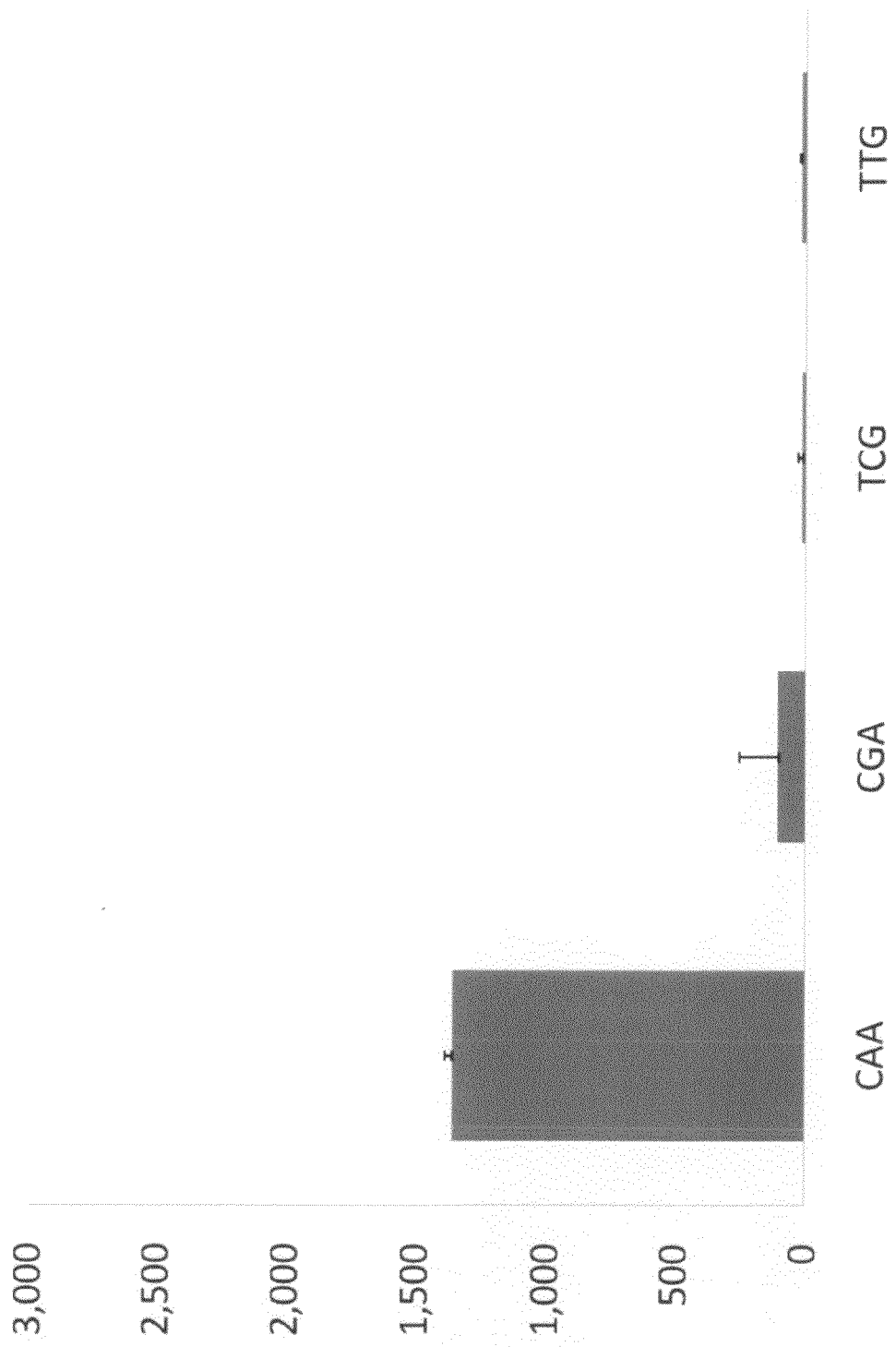

FIG. 27 depicts the specificity of an exemplary TALEN chosen for RVD analysis. The TALEN was designed to bind to the 11 base target sequence 5'-TTGACAATCCT-3' (SEQ ID NO:178). Shown are the DNA binding results determine by ELISA analysis when this target is altered at position 6, such that the identity of the target at positions 5-7 is either CAA (designed target), CGA, TCG or TTG.

Figure 28:
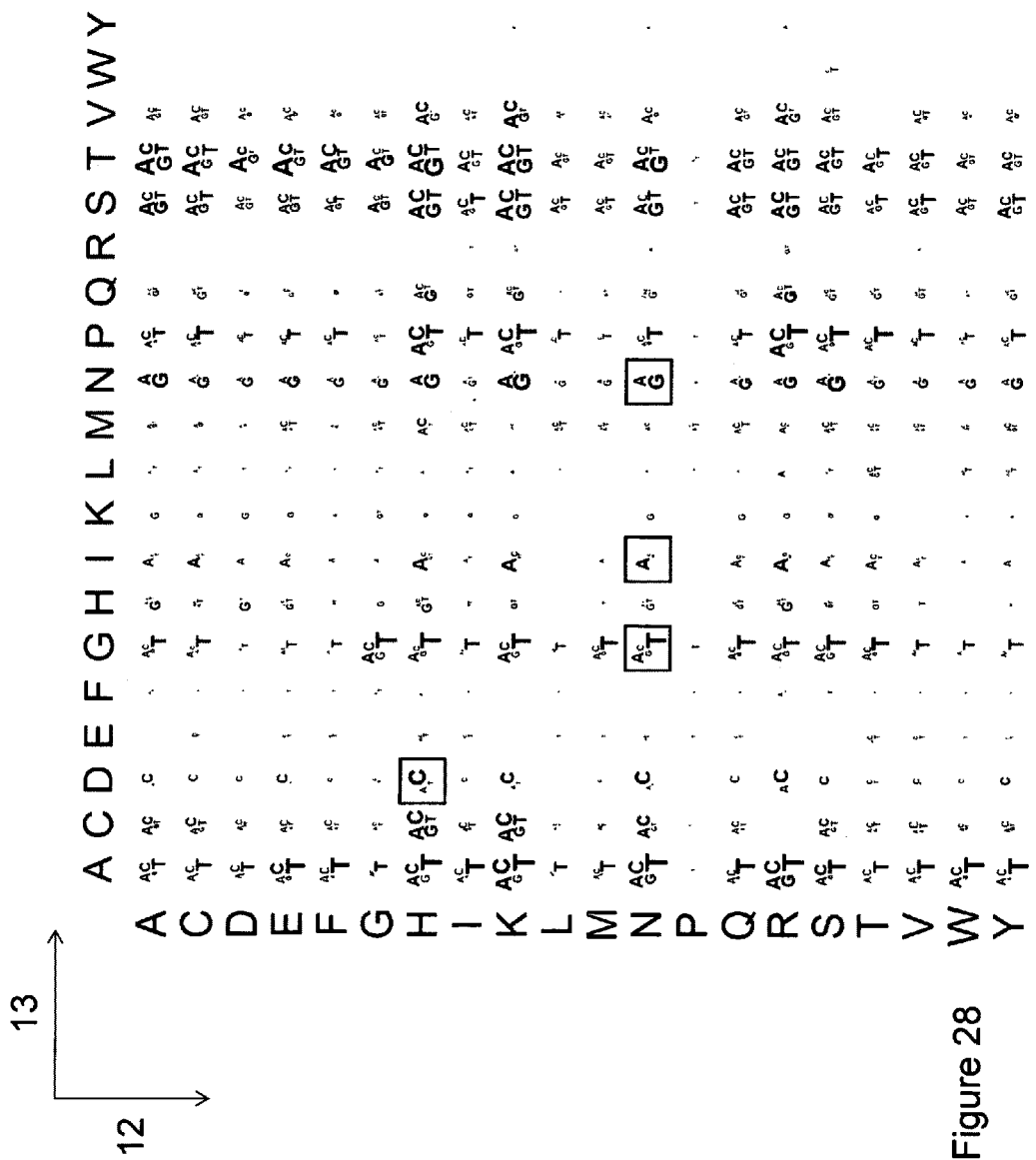

FIG. 28 is a graphical display of the ELISA affinities measured for all the RVDs tested. The data are shown in a 20×20 grid where the first amino acid of the RVD (position 12) is indicated on the vertical left of the grid and the second amino acid of the RVD (position 13) is indicated horizontally above the grid. The size of the letters A, C, G, and T in each grid is scaled based on the square root of the normalized ELISA signal for the CAA site, CCA site, and CGA site and CTA site respectively. Many RVDs have improved DNA binding properties with respect to the naturally occurring HD, NI, NG, NS, NN, IG, HG, and NK RVDs. The four RVDs that are the most frequently found in nature (HD, NG, NI, and NN) are boxed for reference. For these four RVDs, the preferred base by ELISA matched expected preferred base.

Figure 29:
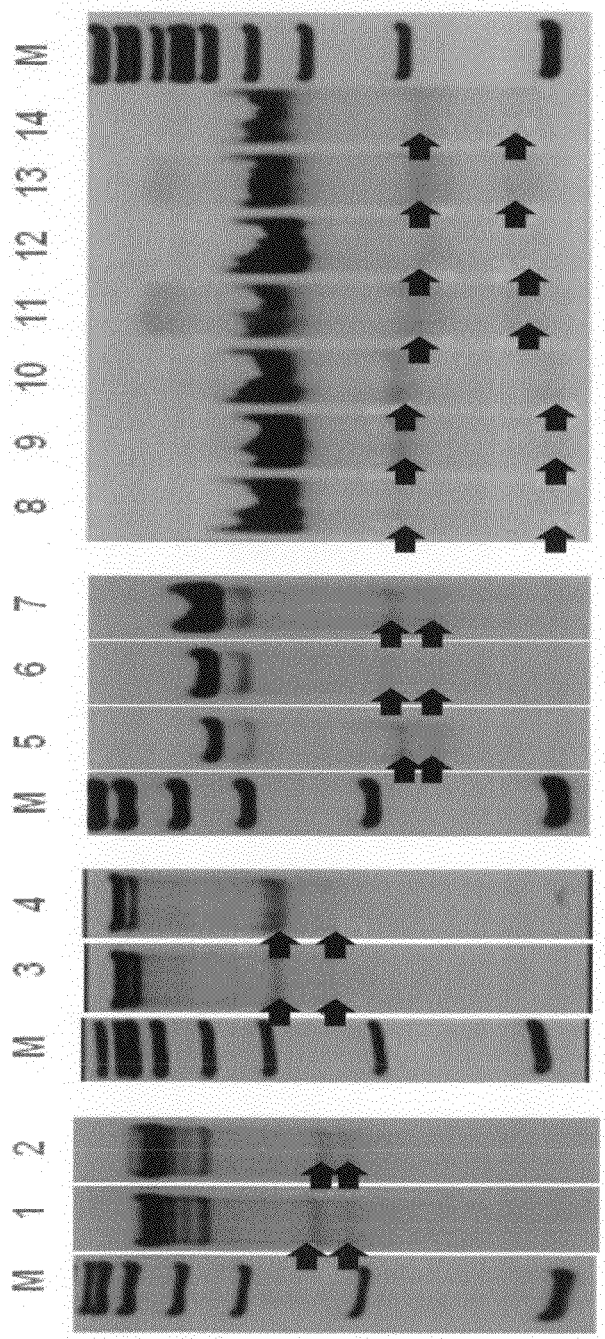

FIG. 29 are gels depicting the results of measurements of activity of TALENs in which the C-terminal half repeat has been altered at the RVD to allow interaction with nucleotide bases other than T. Shown TALEN activities as determined by Cel-I assay as described above. Arrow heads indicate bands that are a result of Cel-I cleavage at indels. Lane assignments are as listed in Example 16, Table 32. These results demonstrate that TALEN C-terminal half repeats can be engineered to bind to each nucleotide base as desired.

FIG. 30 are gels depicting the measurement of TALEN activity using TALENs that have TALE repeat units comprising either fully atypical RVDs (Fully Substituted), repeat domains where all the repeat units of one type or specificity have been substituted (e.g. all repeat units with RVDs that specify 'T' etc.) with atypical RVDs (Type Substitutions), or TALENs where only one repeat unit with the array has been substituted with an atypical RVD-comprising repeat unit (Singly Substituted). Activity assays were carried out either at 37 degrees or under cold shock conditions (30 degrees), and quantitation of any measurable NHEJ activity is indicated on the lanes.

Figure 31:
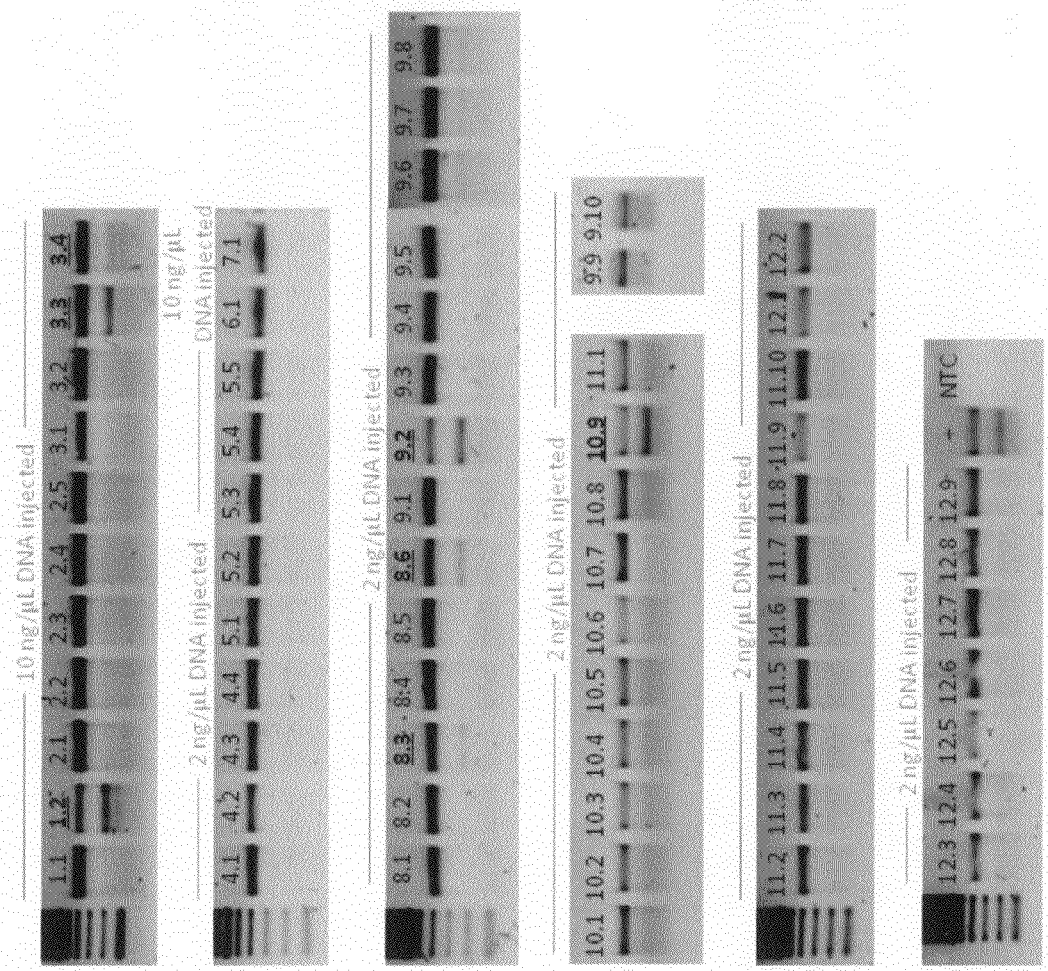

FIG. 31 is a series of gels depicting the presence of NHEJ events in rat pups born following TALEN treatment of rat embryos. Genomic DNA was isolated from the pups and PCR was performed on the region surrounding the nuclease target site. The product was then examined for NHEJ induced mismatches using the T7 endonuclease. The arrow indicates the band that is produced from the presence of a mismatch. 7 of 66 pups examined (11%) were positive for an NHEJ event.

DETAILED DESCRIPTION OF THE INVENTION

Introduction

The present application demonstrates that TALE-repeat domains can be engineered to recognize a desired endogenous DNA sequence and that fusing functional domains to such engineered TALE-repeat domains can be used to modify the functional state, or the actual genomic DNA sequence of an endogenous cellular locus, including a gene, that is present in its native chromatin environment. The present invention thus provides TALE-fusion DNA binding proteins that have been engineered to specifically recognize, with high efficacy, endogenous cellular loci including genes. As a result, the TALE-fusions of the invention can be used to regulate endogenous gene expression, both through activation and repression of endogenous gene transcription. The TALE-fusions can also be linked to other regulatory or functional domains, for example nucleases, transposases or methylases, to modify endogenous chromosomal sequences.

The methods and compositions described herein allow for novel human and mammalian therapeutic applications, e.g., treatment of genetic diseases, cancer, fungal, protozoal, bacterial, and viral infection, ischemia, vascular disease, arthritis, immunological disorders, etc., as well as providing for functional genomics assays, and generating engineered cell lines for research and drug screening, and means for developing plants with altered phenotypes, including but not limited to, increased disease resistance, and altering fruit ripening characteristics, sugar and oil composition, yield, and color.

As described herein, two or more TALE-fusions can be administered to any cell, recognizing either the same target endogenous cellular gene, or different target endogenous cellular genes.

In another embodiment, the TALE-fusion protein is linked to at least one or more regulatory domains, described below. Non-limiting examples of regulatory or functional domains include transcription factor repressor or activator domains such as KRAB and VP16, co-repressor and co-activator domains, DNA methyl transferases, histone acetyltransferases, histone deacetylases, and DNA cleavage domains such as the cleavage domain from the endonuclease FokI.

Described herein are also compositions and methods including fusion proteins comprising one or more TALE-repeat units, an N-cap and, optionally, a C-cap fused to nuclease domains useful for genomic editing (e.g., cleaving of genes; alteration of genes, for example by cleavage followed by insertion (physical insertion or insertion via homology-directed repair) of an exogenous sequence and/or cleavage followed by NHEJ; partial or complete inactivation of one or more genes; generation of alleles with altered functional states of endogenous genes, insertion of regulatory elements; etc.) and alterations of the genome which are carried into the germline. Also disclosed are methods of making and using these compositions (reagents), for example to edit (alter) one or more genes in a target cell. Thus, the methods and compositions described herein provide highly efficient methods for targeted gene alteration (e.g., knock-in) and/or knockout (partial or complete) of one or more genes and/or for randomized mutation of the sequence of any target allele, and, therefore, allow for the generation of animal models of human diseases.

Also disclosed herein are compositions (C-caps) for linking a nuclease domain to a TALE repeat array that provide highly active nuclease function. In some embodiments the C-cap comprises peptide sequence from a native TALE C-terminal flanking sequence. In other embodiments, the C-cap comprises peptide sequence from a TALE repeat domain. In yet another embodiment the C-cap comprises non-TALE sequences. C-caps may also exhibit a chimeric structure, containing peptide sequences from native TALE C-terminal flanking sequence and/or TALE repeat domains and/or neither of these sources.

TALENs can also be engineered to allow the insertion of a donor of interest into a safe harbor locus such as AAVS1 (see co-owned US Patent Publication 20080299580) or CCR5 (see co-owned United States Patent Publication 20080159996). The donor can comprise a gene of interest or can encode an RNA of interest such as an shRNA, RNAi or miRNA.

The expression of engineered TALE-fusion proteins (e.g., transcriptional activators, transcriptional repressors and nucleases) can be also controlled by systems typified by the tet-regulated systems and the RU-486 system (see, e.g., Gossen & Bujard, *Proc Natl Acad Sci* 89:5547 (1992); Oligino et al., *Gene Ther.* 5:491-496 (1998); Wang et al., *Gene Ther.* 4:432-441 (1997); Neering et al, *Blood* 88:1147-1155 (1996); and Rendahl et al., *Nat. Biotechnol.* 16:757-761 (1998)). These impart small molecule control on the expression of the TALE-fusion activators and repressors and thus impart small molecule control on the target gene(s) of interest. This beneficial feature could be used in cell culture models, in gene therapy, and in transgenic animals and plants.

General

Practice of the methods, as well as preparation and use of the compositions disclosed herein employ, unless otherwise indicated, conventional techniques in molecular biology, biochemistry, chromatin structure and analysis, computational chemistry, cell culture, recombinant DNA and related fields as are within the skill of the art. These techniques are fully explained in the literature. See, for example, Sambrook et al. MOLECULAR CLONING: A LABORATORY MANUAL, Second edition, Cold Spring Harbor Laboratory Press, 1989 and Third edition, 2001; Ausubel et al., CURRENT PROTOCOLS IN MOLECULAR BIOLOGY, John Wiley & Sons, New York, 1987 and periodic updates; the series METHODS IN ENZYMOLOGY, Academic Press, San Diego; Wolffe, CHROMATIN STRUCTURE AND FUNCTION, Third edition, Academic Press, San Diego, 1998; METHODS IN ENZYMOLOGY, Vol. 304, "Chromatin" (P. M. Wassarman and A. P. Wolffe, eds.), Academic Press, San Diego, 1999; and METHODS IN MOLECULAR BIOLOGY, Vol. 119, "Chromatin Protocols" (P. B. Becker, ed.) Humana Press, Totowa, 1999.

Definitions

The terms "nucleic acid," "polynucleotide," and "oligonucleotide" are used interchangeably and refer to a deoxyribonucleotide or ribonucleotide polymer, in linear or circular conformation, and in either single- or double-stranded form. For the purposes of the present disclosure, these terms are not to be construed as limiting with respect to the length of a polymer. The terms can encompass known analogues of natural nucleotides, as well as nucleotides that are modified in the base, sugar and/or phosphate moieties (e.g., phosphorothioate backbones). In general, an analogue of a particular nucleotide has the same base-pairing specificity; i.e., an analogue of A will base-pair with T.

The terms "polypeptide," "peptide" and "protein" are used interchangeably to refer to a polymer of amino acid residues. The term also applies to amino acid polymers in which one or more amino acids are chemical analogues or modified derivatives of a corresponding naturally-occurring amino acids.

"Binding" refers to a sequence-specific, non-covalent interaction between macromolecules (e.g., between a protein and a nucleic acid). Not all components of a binding interaction need be sequence-specific (e.g., contacts with phosphate residues in a DNA backbone), as long as the interaction as a whole is sequence-specific. Such interactions are generally characterized by a dissociation constant ($K_d$) of $10^{-6}$ M or lower. "Affinity" refers to the strength of binding: increased binding affinity being correlated with a lower $K_d$.

A "binding protein" is a protein that is able to bind non-covalently to another molecule. A binding protein can bind to, for example, a DNA molecule (a DNA-binding protein), an RNA molecule (an RNA-binding protein) and/or a protein molecule (a protein-binding protein). In the case of a protein-binding protein, it can bind to itself (to form homodimers, homotrimers, etc.) and/or it can bind to one or more molecules of a different protein or proteins. A binding protein can have more than one type of binding activity. For example, zinc-finger proteins have DNA-binding, RNA-binding and protein-binding activity.

A "TALE-repeat domain" (also "repeat array") is a sequence that is involved in the binding of the TALE to its cognate target DNA sequence and that comprises one or more TALE "repeat units." A single "repeat unit" (also referred to as a "repeat") is typically 33-35 amino acids in length and exhibits at least some sequence homology with other TALE repeat sequences within a naturally occurring TALE protein. A TALE repeat unit as described herein is generally of the form $(X)^{1 \text{ to } 11}\text{-}(X^{RVD})_2\text{-}(X)_{20\text{-}22}$ (SEQ ID NO:399) where $X^{RVD}$ (positions 12 and 13) exhibit hypervariability in naturally occurring TALE proteins. Altering the identity of the amino acids at positions 12 and 13 can alter the preference for the identity of the DNA nucleotide (or pair of complementary nucleotides in double-stranded DNA) with which the repeat unit interacts. An "atypical" RVD is an RVD sequence (positions 12 and 13) that occurs infrequently or never in nature, for example, in less than 5% of naturally occurring TALE proteins, preferably in less than 2% of naturally occurring TALE proteins and even more preferably less than 1% of naturally occurring TALE proteins. An atypical RVD can be non-naturally occurring.

The terms "N-cap" polypeptide and "N-terminal sequence" are used to refer to an amino acid sequence (polypeptide) that flanks the N-terminal portion of the TALE repeat domain. The N-cap sequence can be of any length (including no amino acids), so long as the TALE-repeat domain(s) function to bind DNA. Thus, an N-cap sequence may be involved in supplying proper structural stabilization for the TALE repeat domain and/or nonspecific contacts with DNA. An N-cap sequence may be naturally occurring or non-naturally occurring, for example it may be derived from the N-terminal region of any full length TALE protein. The N-cap sequence is preferably a fragment (truncation) of a polypeptide found in full-length TALE proteins, for example any truncation of a N-terminal region flanking the TALE repeat domain in a naturally occurring TALE protein that is sufficient to support DNA-binding function of the TALE-repeat domain or provide support for TALE fusion protein activity. When each TALE-repeat unit comprises a typical RVD and/or when the C-cap comprises a full-length naturally occurring C-terminal region of a TALE protein, the N-cap sequence does not comprise a full-length N-terminal region of a naturally occurring TALE protein. Thus, as noted above, this sequence is not necessarily involved in DNA recognition, but may enhance efficient and specific function at endogenous target DNA or efficient activity of the TALE fusion protein. The portion of the N-cap sequence closest to the N-terminal portion of the TALE repeat domain may bear some homology to a TALE repeat unit and is referred to as the "R0 repeat." Typically, the preferred nucleotide to the position immediately 5' of the target site is thymidine (T). It may be that the R0 repeat portion of the N-cap prefers to interact with a T (or the A base-paired to the T in double-stranded DNA) adjacent to the target sequence specified by the TALE repeats. Shown below is one example of an R0 sequence:

LDTGQLLKIAKRGGVTAVEAVHAWRNALTGAPLN (SEQ ID NO:1)

The term "C-cap" or "C-terminal region" refers to optionally present amino acid sequences (polypeptides) that may be flanking the C-terminal portion of the TALE repeat domain. The C-cap can also comprise any part of a terminal C-terminal TALE repeat, including 0 residues, truncations of a TALE repeat or a full TALE repeat. The first 20 residues of the C-terminal region are typically homologous to the first 20 residues of a TALE repeat unit and may contain an RVD sequence capable of specifying the preference of nucleotides 3' of the DNA sequence specified by the TALE repeat domain. When present, this portion of the C-terminal region homologous to the first 20 residues of a TALE repeat is also referred to as the "half repeat." The numbering scheme of residues in the C-terminal region reflects this typical partial homology where the number scheme starts at C−20, increments to C−19, C−18, C−17, C−16, C−15, C−14, C−13, C−12, C−11, C−10, C−9, C−8, C−7, C−6, C−5, C−4, C−3, C−2, C−1, increments to C+1, and then increments to C+2, C+3, etc. towards the C-terminus of the polypeptide. A C+28 C-cap refers to the sequence from residue C−20 to residue C+28 (inclusive) and thus has a length of 48 residues. The C-cap sequences may be naturally occurring (e.g., fragments of naturally occurring proteins) or non-naturally occurring (e.g., a fragment of a naturally occurring protein comprising one or more amino acid deletions, substitutions and/or additions), or any other natural or non-natural sequence with the ability to act as a C cap. The C-terminal region is not absolutely required for the DNA-binding function of the TALE repeat domain(s), but, in some embodiments, a C-cap may interact with DNA and also may enhance the activity of functional domains, for example in a fusion protein comprising a nuclease at the C-terminal to the TALE repeat domain.

A "zinc-finger DNA binding protein" (or binding domain) is a protein, or a domain within a larger protein, that binds DNA in a sequence-specific manner through one or more zinc-fingers, which are regions of amino acid sequence within the binding domain whose structure is stabilized through coordination of a zinc ion. The term zinc-finger DNA binding protein is often abbreviated as zinc-finger protein or ZFP.

A "selected" zinc-finger protein or protein comprising a TALE-repeat domain is a protein whose production results primarily from an empirical process such as phage display, interaction trap or hybrid selection. See e.g., U.S. Pat. Nos. 5,789,538; 5,925,523; 6,007,988; 6,013,453; 6,200,759; WO 95/19431; WO 96/06166; WO 98/53057; WO 98/54311; WO 00/27878; WO 01/60970 WO 01/88197 and WO 02/099084.

The term "sequence" refers to a nucleotide sequence of any length, which can be DNA or RNA; can be linear, circular or branched and can be either single-stranded or double stranded. The term "donor sequence" refers to a nucleotide sequence that is inserted into a genome. A donor sequence can be of any length, for example between 2 and 10,000 nucleotides in length (or any integer value therebetween or thereabove), preferably between about 100 and 1,000 nucleotides in length (or any integer therebetween), more preferably between about 200 and 500 nucleotides in length.

A "homologous, non-identical sequence" refers to a first sequence which shares a degree of sequence identity with a second sequence, but whose sequence is not identical to that of the second sequence. For example, a polynucleotide comprising the wild-type sequence of a mutant gene is homologous and non-identical to the sequence of the mutant gene. In certain embodiments, the degree of homology between the two sequences is sufficient to allow homologous recombination therebetween, utilizing normal cellular mechanisms. Two homologous non-identical sequences can be any length and their degree of non-homology can be as small as a single nucleotide (e.g., for correction of a genomic point mutation by targeted homologous recombination) or as large as 10 or more kilobases (e.g., for insertion of a gene at a predetermined ectopic site in a chromosome). Two polynucleotides comprising the homologous non-identical sequences need not be the same length. For example, an exogenous polynucleotide (i.e., donor polynucleotide) of between 20 and 10,000 nucleotides or nucleotide pairs can be used.

Techniques for determining nucleic acid and amino acid sequence identity are known in the art. Typically, such techniques include determining the nucleotide sequence of the mRNA for a gene and/or determining the amino acid sequence encoded thereby, and comparing these sequences to a second nucleotide or amino acid sequence. Genomic sequences can also be determined and compared in this fashion. In general, identity refers to an exact nucleotide-to-nucleotide or amino acid-to-amino acid correspondence of two polynucleotides or polypeptide sequences, respectively. Two or more sequences (polynucleotide or amino acid) can be compared by determining their percent identity. The percent identity of two sequences, whether nucleic acid or amino acid sequences, is the number of exact matches between two aligned sequences divided by the length of the shorter sequences and multiplied by 100.

Alternatively, the degree of sequence similarity between polynucleotides can be determined by hybridization of polynucleotides under conditions that allow formation of stable duplexes between homologous regions, followed by digestion with single-stranded-specific nuclease(s), and size determination of the digested fragments. Two nucleic acid, or two polypeptide sequences are substantially homologous to each other when the sequences exhibit at least about 70%-75%, preferably 80%-82%, more preferably 85%-90%, even more preferably 92%, still more preferably 95%, and most preferably 98% sequence identity over a defined length of the molecules, as determined using the methods above. As used herein, substantially homologous also refers to sequences showing complete identity to a specified DNA or polypeptide sequence. DNA sequences that are substantially homologous can be identified in a Southern hybridization experiment under, for example, stringent conditions, as defined for that particular system. Defining appropriate hybridization conditions is within the skill of the art. See, e.g., Sambrook et al., supra; *Nucleic Acid Hybridization: A Practical Approach*, editors B. D. Hames and S. J. Higgins, (1985) Oxford; Washington, D.C.; IRL Press).

"Recombination" refers to a process of exchange of genetic information between two polynucleotides. For the purposes of this disclosure, "homologous recombination (HR)" refers to the specialized form of such exchange that takes place, for example, during repair of double-strand breaks in cells via homology-directed repair mechanisms. This process requires nucleotide sequence homology, uses a "donor" molecule to template repair of a "target" molecule (i.e., the one that experienced the double-strand break), and is variously known as "non-crossover gene conversion" or "short tract gene conversion," because it leads to the transfer of genetic information from the donor to the target. Without wishing to be bound by any particular theory, such transfer can involve mismatch correction of heteroduplex DNA that forms between the broken target and the donor, and/or "synthesis-dependent strand annealing," in which the donor is used to resynthesize genetic information that will become part of the target, and/or related processes. Such specialized HR often results in an alteration of the sequence of the target molecule such that part or all of the sequence of the donor polynucleotide is incorporated into the target polynucleotide.

In the methods of the disclosure, one or more targeted nucleases as described herein create a double-stranded break in the target sequence (e.g., cellular chromatin) at a predetermined site, and a "donor" polynucleotide, having homology to the nucleotide sequence in the region of the break, can be introduced into the cell. The presence of the double-stranded break (DSB) has been shown to facilitate integration of the donor sequence. The donor sequence may be physically integrated or, alternatively, the donor polynucleotide is used as a template for repair of the break via homologous recombination, resulting in the introduction of all or part of the nucleotide sequence as in the donor into the cellular chromatin. Thus, a first sequence in cellular chromatin can be altered and, in certain embodiments, can be converted into a sequence present in a donor polynucleotide. Thus, the use of the terms "replace" or "replacement" can be understood to represent replacement of one nucleotide sequence by another, (i.e., replacement of a sequence in the informational sense), and does not necessarily require physical or chemical replacement of one polynucleotide by another. In some embodiments, two DSBs are introduced by the targeted nucleases described herein, resulting in the deletion of the DNA in between the DSBs. In some embodiments, the "donor" polynucleotides are inserted between these two DSBs.

Thus, in certain embodiments, portions of the donor sequence that are homologous to sequences in the region of interest exhibit between about 80 to 99% (or any integer therebetween) sequence identity to the genomic sequence that is replaced. In other embodiments, the homology between the donor and genomic sequence is higher than 99%, for example if only 1 nucleotide differs as between donor and genomic sequences of over 100 contiguous base pairs. In certain cases, a non-homologous portion of the donor sequence can contain sequences not present in the region of interest, such that new sequences are introduced into the region of interest. In these instances, the non-homologous sequence is generally flanked by sequences of 50-1,000 base pairs (or any integral value therebetween) or any number of base pairs greater than 1,000, that are homologous or identical to sequences in the region of interest. In other embodiments, the donor sequence is non-homologous to the first sequence, and is inserted into the genome by non-homologous recombination mechanisms.

In any of the methods described herein, additional TALE-fusion proteins fused to nuclease domains as well as additional pairs of TALE- (or zinc finger) nucleases can be used for additional double-stranded cleavage of additional target sites within the cell.

Any of the methods described herein can be used for partial or complete inactivation of one or more target sequences in a cell by targeted integration of donor sequence that disrupts expression of the gene(s) of interest. Cell lines with partially or completely inactivated genes are also provided.

Furthermore, the methods of targeted integration as described herein can also be used to integrate one or more exogenous sequences. The exogenous nucleic acid sequence can comprise, for example, one or more genes or cDNA molecules, or any type of coding or noncoding sequence, as well as one or more control elements (e.g., promoters). In addition, the exogenous nucleic acid sequence may produce one or more RNA molecules (e.g., small hairpin RNAs (shRNAs), inhibitory RNAs (RNAis), microRNAs (miRNAs), etc.).

"Cleavage" refers to the breakage of the covalent backbone of a DNA molecule. Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. DNA cleavage can result in the production of either blunt ends or staggered ends. In certain embodiments, fusion polypeptides are used for targeted double-stranded DNA cleavage.

A "cleavage half-domain" is a polypeptide sequence which, in conjunction with a second polypeptide (either identical or different) forms a complex having cleavage activity (preferably double-strand cleavage activity). The terms "first and second cleavage half-domains;" "+ and − cleavage half-domains" and "right and left cleavage half-domains" are used interchangeably to refer to pairs of cleavage half-domains that dimerize.

An "engineered cleavage half-domain" is a cleavage half-domain that has been modified so as to form obligate heterodimers with another cleavage half-domain (e.g., another engineered cleavage half-domain). See, also, U.S. Patent Publication Nos. 2005/0064474; 2007/0218528 and 2008/0131962, incorporated herein by reference in their entireties.

"Chromatin" is the nucleoprotein structure comprising the cellular genome. Cellular chromatin comprises nucleic acid, primarily DNA, and protein, including histones and non-histone chromosomal proteins. The majority of eukaryotic cellular chromatin exists in the form of nucleosomes, wherein a nucleosome core comprises approximately 150 base pairs of DNA associated with an octamer comprising two each of histones H2A, H2B, H3 and H4; and linker DNA (of variable length depending on the organism) extends between nucleosome cores. A molecule of histone H1 is generally associated with the linker DNA. For the purposes of the present disclosure, the term "chromatin" is meant to encompass all types of cellular nucleoprotein, both prokaryotic and eukaryotic. Cellular chromatin includes both chromosomal and episomal chromatin.

A "chromosome," is a chromatin complex comprising all or a portion of the genome of a cell. The genome of a cell is often characterized by its karyotype, which is the collection of all the chromosomes that comprise the genome of the cell. The genome of a cell can comprise one or more chromosomes.

An "episome" is a replicating nucleic acid, nucleoprotein complex or other structure comprising a nucleic acid that is not part of the chromosomal karyotype of a cell. Examples of episomes include plasmids and certain viral genomes.

A "target site" or "target sequence" is a nucleic acid sequence that defines a portion of a nucleic acid to which a binding molecule will bind, provided sufficient conditions for binding exist. For example, the sequence 5'-GAATTC-3' is a target site for the Eco RI restriction endonuclease.

"Plant" cells include, but are not limited to, cells of monocotyledonous (monocots) or dicotyledonous (dicots) plants. Non-limiting examples of monocots include cereal plants such as maize, rice, barley, oats, wheat, sorghum, rye, sugarcane, pineapple, onion, banana, and coconut. Non-limiting examples of dicots include tobacco, tomato, sunflower, cotton, sugarbeet, potato, lettuce, melon, soybean, canola (rapeseed), and alfalfa. Plant cells may be from any part of the plant and/or from any stage of plant development.

An "exogenous" molecule is a molecule that is not normally present in a cell, but can be introduced into a cell by one or more genetic, biochemical or other methods. "Normal presence in the cell" is determined with respect to the particular developmental stage and environmental conditions of the cell. Thus, for example, a molecule that is present only during embryonic development of muscle is an exogenous molecule with respect to an adult muscle cell. Similarly, a molecule induced by heat shock is an exogenous molecule with respect to a non-heat-shocked cell. An exogenous molecule can comprise, for example, a functioning version of a malfunctioning endogenous molecule or a malfunctioning version of a normally-functioning endogenous molecule. An exogenous molecule can also be a molecule normally found in another species, for example, a human sequence introduced into an animal's genome.

An exogenous molecule can be, among other things, a small molecule, such as is generated by a combinatorial chemistry process, or a macromolecule such as a protein, nucleic acid, carbohydrate, lipid, glycoprotein, lipoprotein, polysaccharide, any modified derivative of the above molecules, or any complex comprising one or more of the above molecules. Nucleic acids include DNA and RNA, can be single- or double-stranded; can be linear, branched or circular; and can be of any length. Nucleic acids include those capable of forming duplexes, as well as triplex-forming nucleic acids. See, for example, U.S. Pat. Nos. 5,176,996 and 5,422,251. Proteins include, but are not limited to, DNA-binding proteins, transcription factors, chromatin remodeling factors, methylated DNA binding proteins, polymerases, methylases, demethylases, acetylases, deacetylases, kinases, phosphatases, integrases, recombinases, ligases, topoisomerases, gyrases and helicases.

An exogenous molecule can be the same type of molecule as an endogenous molecule, e.g., an exogenous protein or nucleic acid. For example, an exogenous nucleic acid can comprise an infecting viral genome, a plasmid or episome introduced into a cell, or a chromosome that is not normally present in the cell. Methods for the introduction of exogenous molecules into cells are known to those of skill in the art and include, but are not limited to, lipid-mediated transfer (i.e., liposomes, including neutral and cationic lipids), electroporation, direct injection, cell fusion, particle bombardment, calcium phosphate co-precipitation, DEAE-dextran-mediated transfer and viral vector-mediated transfer.

By contrast, an "endogenous" molecule is one that is normally present in a particular cell at a particular developmental stage under particular environmental conditions. For example, an endogenous nucleic acid can comprise a chromosome, the genome of a mitochondrion, chloroplast or other organelle, or a naturally-occurring episomal nucleic acid. Additional endogenous molecules can include proteins, for example, transcription factors and enzymes.

A "fusion" molecule is a molecule in which two or more subunit molecules are linked, preferably covalently. The subunit molecules can be the same chemical type of molecule, or can be different chemical types of molecules. Examples of the first type of fusion molecule include, but are not limited to, fusion proteins (for example, a fusion between a TALE-repeat domain and a cleavage domain) and fusion nucleic acids (for example, a nucleic acid encoding the fusion protein described supra). Examples of the second type of fusion molecule include, but are not limited to, a fusion between a triplex-forming nucleic acid and a polypeptide, and a fusion between a minor groove binder and a nucleic acid.

Expression of a fusion protein in a cell can result from delivery of the fusion protein to the cell or by delivery of a polynucleotide encoding the fusion protein to a cell, wherein the polynucleotide is transcribed, and the transcript is translated, to generate the fusion protein. Trans-splicing, polypeptide cleavage and polypeptide ligation can also be involved in expression of a protein in a cell. Methods for polynucleotide and polypeptide delivery to cells are presented elsewhere in this disclosure.

A "gene," for the purposes of the present disclosure, includes a DNA region encoding a gene product (see infra), as well as all DNA regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

"Gene expression" refers to the conversion of the information, contained in a gene, into a gene product. A gene product can be the direct transcriptional product of a gene (e.g., mRNA, tRNA, rRNA, antisense RNA, ribozyme, structural RNA, shRNA, RNAi, miRNA or any other type of RNA) or a protein produced by translation of a mRNA. Gene products also include RNAs which are modified, by processes such as capping, polyadenylation, methylation, and editing, and proteins modified by, for example, methylation, acetylation, phosphorylation, ubiquitination, ADP-ribosylation, myristilation, and glycosylation.

A "gap size" refers to the nucleotides between the two TALE targets sites on the nucleic acid target. Gaps can be any size, including but not limited to between 1 and 100 base pairs, or 5 and 30 base pairs, preferably between 10 and 25 base pairs, and more preferably between 12 and 21 base pairs. Thus, a preferable gap size may be 12, 13, 14, 15, 16, 17, 18, 19, 20, or 21 base pairs.

"Modulation" of gene expression refers to a change in the activity of a gene. Modulation of expression can include, but is not limited to, gene activation and gene repression. Genome editing (e.g., cleavage, alteration, inactivation, donor integration, random mutation) can be used to modulate expression. Gene inactivation refers to any reduction in gene expression as compared to a cell that does not include a modifier as described herein. Thus, gene inactivation may be partial or complete.

A "region of interest" is any region of cellular chromatin, such as, for example, a gene or a non-coding sequence within or adjacent to a gene, in which it is desirable to bind an exogenous molecule. Binding can be for the purposes of targeted DNA cleavage and/or targeted recombination. A region of interest can be present in a chromosome, an episome, an organellar genome (e.g., mitochondrial, chloroplast), or an infecting viral genome, for example. A region of interest can be within the coding region of a gene, within transcribed non-coding regions such as, for example, leader sequences, trailer sequences or introns, or within non-transcribed regions, either upstream or downstream of the coding region. A region of interest can be as small as a single nucleotide pair or up to 2,000 nucleotide pairs in length, or any integral value of nucleotide pairs.

The terms "operative linkage" and "operatively linked" (or "operably linked") are used interchangeably with reference to a juxtaposition of two or more components (such as sequence elements), in which the components are arranged such that both components function normally and allow the possibility that at least one of the components can mediate a function that is exerted upon at least one of the other components. By way of illustration, a transcriptional regulatory sequence, such as a promoter, is operatively linked to a coding sequence if the transcriptional regulatory sequence controls the level of transcription of the coding sequence in response to the presence or absence of one or more transcriptional regulatory factors: A transcriptional regulatory sequence is generally operatively linked in cis with, a coding sequence, but need not be directly adjacent to it. For example, an enhancer is a transcriptional regulatory sequence that is operatively linked to a coding sequence, even though they are not contiguous.

With respect to fusion polypeptides, the term "operatively linked" can refer to the fact that each of the components performs the same function in linkage to the other component as it would if it were not so linked. For example, with respect to a fusion polypeptide in which a TALE-repeat domain is fused to a cleavage domain, the TALE-repeat domain and the cleavage domain are in operative linkage if, in the fusion polypeptide, the TALE-repeat domain portion is able to bind its target site and/or its binding site, while the cleavage domain is able to cleave DNA in the vicinity of the target site.

A "functional fragment" of a protein, polypeptide or nucleic acid is a protein, polypeptide or nucleic acid whose sequence is not identical to the full-length protein, polypeptide or nucleic acid, yet retains the same or has enhanced function as compared to the full-length protein, polypeptide or nucleic acid. Additionally, a functional fragment may have lesser function than the full-length protein, polypeptide or nucleic acid, but still have adequate function as defined by the user. A functional fragment can possess more, fewer, or the same number of residues as the corresponding native molecule, and/or can contain one or more amino acid or nucleotide substitutions. Methods for determining the function of a nucleic acid (e.g., coding function, ability to hybridize to another nucleic acid) are well-known in the art. Similarly, methods for determining protein function are well-known. For example, the DNA-binding function of a polypeptide can be determined, for example, by filter-binding, electrophoretic mobility-shift, or immunoprecipitation assays. DNA cleavage can be assayed by gel electrophoresis. See Ausubel et al., supra. The ability of a protein to interact with another protein can be determined, for example, by co-immunoprecipitation, two-hybrid assays or complementation, both genetic and biochemical. See, for example, Fields et al. (1989) Nature 340: 245-246; U.S. Pat. No. 5,585,245 and PCT WO 98/44350.

TALE-repeat domains can be "engineered" to bind to a predetermined nucleotide sequence, for example via engineering (altering one or more amino acids) of the hypervariable diresidue region, for example positions 12 and/or 13 of a repeat unit within a TALE protein. In some embodiments, the amino acids at positions 4, 11, and 32 may be engineered. In other embodiments, atypical RVDs may be selected for use in an engineered TALE protein, enabling specification of a wider range of non-natural target sites. For example, a NK RVD may be selected for use in recognizing a G nucleotide in the target sequence. In other embodiments, amino acids in the repeat unit may be altered to change the characteristics (i.e. stability or secondary structure) of the repeat unit. Therefore, engineered TALE proteins are proteins that are non-naturally occurring. In some embodiments, the genes encoding TALE repeat domains are engineered at the DNA level such that the codons specifying the TALE repeat amino acids are altered, but the specified amino acids are not (e.g., via known techniques of codon optimization). Non-limiting examples of engineered TALE proteins are those obtained by design and/or selection. A designed TALE protein is a protein not occurring in nature whose design/composition results principally from rational criteria. Rational criteria for design include application of substitution rules and computerized algorithms for processing information in a database storing information of existing TALE designs and binding data. A "selected" TALE-repeat domain is a non-naturally occurring or atypical domain whose production results primarily from an empirical process such as phage display, interaction trap or hybrid selection.

A "multimerization domain" is a domain incorporated at the amino, carboxy or amino and carboxy terminal regions of a TALE-fusion protein. These domains allow for multimerization of multiple TALE-fusion protein units. Examples of multimerization domains include leucine zippers. Multimerization domains may also be regulated by small molecules wherein the multimerization domain assumes a proper conformation to allow for interaction with another multimerization domain only in the presence of a small molecule or external ligand. In this way, exogenous ligands can be used to regulate the activity of these domains.

The target sites useful in the above methods can be subject to evaluation by other criteria or can be used directly for design or selection (if needed) and production of a TALE-fusion protein specific for such a site. A further criterion for evaluating potential target sites is their proximity to particular regions within a gene. Target sites can be selected that do not necessarily include or overlap segments of demonstrable biological significance with target genes, such as regulatory sequences. Other criteria for further evaluating target segments include the prior availability of TALE-fusion proteins binding to such segments or related segments, and/or ease of designing new TALE-fusion proteins to bind a given target segment.

After a target segment has been selected, a TALE-fusion protein that binds to the segment can be provided by a variety of approaches. Once a TALE-fusion protein has been selected, designed, or otherwise provided to a given target segment, the TALE-fusion protein or the DNA encoding it are synthesized. Exemplary methods for synthesizing and expressing DNA encoding TALE-repeat domain-containing proteins are described below. The TALE-fusion protein or a polynucleotide encoding it can then be used for modulation of expression, or analysis of the target gene containing the target site to which the TALE-fusion protein binds.

TALE DNA Binding Domains

The polypeptides described herein comprise one or more (e.g., 1, 2, 3, 4, 5, 6, 7, 8, 9, 10, 11, 12, 13, 14, 15, 16, 17, 18, 19, 20 or even more) TALE-repeat units. TALE DNA binding domains, comprising multiple TALE-repeat units, have been studied to determine the sequences responsible for specificity. Within one organism, the TALE repeats typically are highly conserved (except for the RVD) but may not be well conserved across different species.

A TALE-repeat unit as found in the polypeptides described herein is generally of the form: $X^1$-$X^2$-$X^3$-$X^4$-$X^5$-$X^6$-$X^7$-$X^8$-$X^9$-$X^{10}$-$X^{11}$-$(X^{RVD})_2$-$(X)_{20\text{-}22}$ (SEQ ID NO:399), where X is any amino acid and $X^{RVD}$ (positions 12 and 13) involved in DNA binding. Non-limiting exemplary embodiments of such domains include: embodiments in which $X^1$ comprises a leucine (L), or methionine (M) residue; embodiments in which $X^{10}$ comprises an alanine (A) residue or a valine (V) residue; embodiments in which $(X)_{20\text{-}22}$ comprises the sequence (Gly or Ser)-$(X)_{19\text{-}21}$ (SEQ ID NO:400); embodiments in which $(X)_{20\text{-}22}$ comprises the sequence $(X)_{3\text{-}4}$-(Ala or Thr)-$(X)_{16\text{-}17}$ (SEQ ID NO:401); embodiments in which $(X)_{20\text{-}22}$ comprises the sequence $(X)_{4\text{-}5}$-(Leu or Val)-$(X)_{15\text{-}16}$ (SEQ ID NO:402); and combinations of any of the above embodiments (e.g., X' comprises a leucine (L) or methionine (M) residue and $X^{10}$ comprises an alanine (A) residue; $X^1$ comprises L or M and $(X)_{20\text{-}22}$ comprises the sequence Gly/Ser-$(X)_{19\text{-}21}$; $(W)_{20\text{-}22}$ comprises the sequence Gly/Ser-$(X)_{2\text{-}3}$-Ala/Thr-$(X)_{16\text{-}17}$; $X^{10}$ comprises an alanine (A) or valine (V) residue and $(X)_{20\text{-}22}$ comprises the sequence Gly/Ser-$(X)_{19\text{-}21}$, etc.).

The TALE-repeat units of the compositions and methods described herein may be derived from any suitable TALE-protein. Non-limiting examples of TALE proteins include TALE proteins derived from *Ralstonia* spp. or *Xanthamonas* spp. Thus, in some embodiments, the DNA-binding domain comprises one or more one or more naturally occurring and/or engineered TALE-repeat units derived from the plant pathogen *Xanthomonas* (see Boch et al, (2009) *Science* 326: 1509-1512 and Moscou and Bogdanove, (2009) *Science* 326: 1501). In other embodiments, the DNA-binding domain comprises one or more naturally occurring and/or engineered TALE-repeat units derived from the plant pathogen *Ralstonia solanacearum*, or other TALE DNA binding domain from the TALE protein family. The TALE DNA binding domains as described herein (comprising at least one TALE repeat unit) can include (i) one or more TALE repeat units not found in nature; (ii) one or more naturally occurring TALE repeat units; (iii) one or more TALE repeat units with atypical RVDs; and combinations of (i), (ii) and/or (iii). In some embodiments, a TALE DNA binding domain of the invention consists of completely non-naturally occurring or atypical repeat units. Furthermore, in polypeptides as described herein comprising two or more TALE-repeat units, the TALE-repeat units (naturally occurring or engineered) may be derived from the same species or alternatively, may be derived from different species.

Table 1 shows an alignment of exemplary repeat units within two TALE proteins. Each TALE repeat is shown on a separate line with the columns indicating the type of repeat, position of the start of that repeat, the name of the repeat, the residues at the hypervariable positions, and the entire repeat sequence.

TABLE 1

Comparison of TALE DNA binding domains from two TALEs from *Xanthomonas*

| Type | Start | Name | RVD | Repeat Sequence | |
|------|-------|------|-----|-----------------|---|
| TALE AAA27592.1 (6.0 repeats) | | | | | |
| full | 288 | R1.0 | NI | LTPEQVVAIASNIGGKQALETVQALLPVLCQAHG | (SEQ ID NO: 2) |
| full | 322 | R2.0 | NG | LTPDQVVAIASNGGGKQALETVQRLLPVLCQAHG | (SEQ ID NO: 3) |
| full | 356 | R3.0 | NI | LTPEQVVAIASNIGGKQALETVQRLLPVLCQAHG | (SEQ ID NO: 4) |
| full | 390 | R4.0 | NI | LTPEQVVAIASNIGGKQALETVQRLLPVLCQAHG | (SEQ ID NO: 5) |
| full | 424 | R5.0 | NG | LTPEQVVAIASNGGGKQALETVQRLLPVLCQAHG | (SEQ ID NO: 6) |
| full | 458 | R6.0 | NG | LTPEQVVAIASNGGGKQALETVQRLLPVLCQAHG | (SEQ ID NO: 6) |
| TALE AAA92974.1 (15.5 repeats): | | | | | |
| full | 287 | R1.0 | NI | LTPDQVVAIASNIGGNQALETVQRLLPVLCQAHG | (SEQ ID NO: 9) |
| full | 321 | R2.0 | HG | LTPDQVVAIASHGGGKQALETVQRLLPVLCQAHG | (SEQ ID NO: 10) |
| full | 355 | R3.0 | NI | LTPDQVVAIASNIGGKQALATVQRLLPVLCQDHG | (SEQ ID NO: 11) |
| full | 389 | R4.0 | HG | LTPDQVVAIASHGGGKQALETVQRLLPVLCQDHG | (SEQ ID NO: 12) |
| full | 423 | R5.0 | NI | LTPDQVVAIASNIGGKQALETVQRLLPVLCQDHG | (SEQ ID NO: 13) |
| full | 457 | R6.0 | NI | LTPDQVVAIASNIGGKQALETVQRLLPVLCQDHG | (SEQ ID NO: 14) |

TABLE 1-continued

Comparison of TALE DNA binding domains from two TALEs from *Xanthomonas*

| Type | Start | Name  | RVD | Repeat Sequence                                           |                   |
|------|-------|-------|-----|-----------------------------------------------------------|-------------------|
| full | 491   | R7.0  | NN  | LTPDQVVAIASNNGGKQALETVQRLLPVLCQTHG                        | (SEQ ID NO: 15)   |
| full | 525   | R8.0  | HD  | LTPDQVVAIANHDGGKQALETVQRLLPVLCQDHG                        | (SEQ ID NO: 16)   |
| full | 559   | R9.0  | NI  | LTPDQVVAIASNIGGKQALATVQRLLPVLCQAHG                        | (SEQ ID NO: 17)   |
| full | 593   | R10.0 | HD  | LTPDQVVAIASHDGGKQALETVQRLLPVLCQDHG                        | (SEQ ID NO: 18)   |
| full | 627   | R11.0 | NN  | LTPDQVVAIASNNGGKQALETVQRLLPVLCQDHG                        | (SEQ ID NO: 19)   |
| full | 661   | R12.0 | HG  | LTPAQVVAIANHGGGKQALETVQRLLPVLCQDHG                        | (SEQ ID NO: 20)   |
| full | 695   | R13.0 | NS  | LTPVQVVAIASNSGGKQALETVQRLLPVLCQDHG                        | (SEQ ID NO: 21)   |
| full | 729   | R14.0 | NG  | LTPVQVVAIASNGGGKQALATVQRLLPVLCQDHG                        | (SEQ ID NO: 22)   |
| full | 763   | R15.0 | HD  | LTPVQVVAIASHDGGKQALETVQRLLPVLCQDHG                        | (SEQ ID NO: 23)   |
| half | 797   | R15.5 | NG  | LTPDQVVAIASNGG-KQALESIVAQLSRPDPALAA                       | (SEQ ID NO: 24)   |

Several TALE DNA binding proteins have been identified and can be found in a standard GenBank search, including: AAB00675.1, (13.5 TALE repeats), AAB69865.1 (13.5 repeats), AAC43587.1 (17.5 repeats), AAD01494.1 (12.5 repeats), AAF98343.1 (25.5 repeats), AAG02079.2 (25.5 repeats), AAN01357.1 (8.5 repeats), AAO72098 (17.5 repeats), AAQ79773.2 (5.5 repeats), AAS46027.1 (28.5 repeats), AAS58127.2 (13.5 repeats), AAS58128.2 (17.5 repeats), AAS58129.3 (18.5 repeats), AAS58130.3 (9.5 repeats), AAT46123.1 (22.5 repeats), AAT46124.1 (26.5 repeats), AAW59491.1 (5.5 repeats), AAW59492.1 (16.5 repeats), AAW59493.1 (19.5 repeats), AAW77510.1 (5.5 repeats), AAY43358 (21.5 repeats), AAY43359.1 (11.5 repeats), AAY43360.1 (14.5 repeats), AAY54166.1 (19.5 repeats), AAY54168.1 (16.5 repeats), AAY54169.1 (12.5 repeats), AAY54170.1 (23.5 repeats), ABB70129.1 (21.5 repeats), ABB70183.1 (22.5 repeats), ABO77779.1 (17.5 repeats), etc.

TALE type proteins have also been found in the bacterium *Ralstonia solanacearum* and Table 2 lists a similar comparison of two examples of these DNA binding domains:

TABLE 2

Comparison of TALE DNA binding domains from two TALE from *Ralstonia*

| Type | Start | Name  | RVD | Repeat Sequence                                           |                   |
|------|-------|-------|-----|-----------------------------------------------------------|-------------------|
|      |       |       |     | TALE ABO27067.1 (13.5 repeats)                            |                   |
| full | 0     | R1.0  | NT  | LTPQQVVAIASNTGGKRALEAVCVQLPVLRAAPYR                       | (SEQ ID NO: 25)   |
| full | 35    | R2.0  | NK  | LSTEQVVAIASNKGGKQALEAVKAHLLDLLGAPYV                       | (SEQ ID NO: 26)   |
| full | 70    | R3.0  | HN  | LDTEQVVAIASHNGGKQALEAVKADLLDLRGAPYA                       | (SEQ ID NO: 27)   |
| full | 105   | R4.0  | HN  | LSTEQVVAIASHNGGKQALEAVKADLLDLRGAPYA                       | (SEQ ID NO: 28)   |
| full | 140   | R5.0  | HN  | LSTEQVVAIASHNGGKQALEAVKAQLLDLRGAPYA                       | (SEQ ID NO: 29)   |
| full | 175   | R6.0  | HN  | LSTAQVVAIASHNGGKQALEAVKAQLLDLRGAPYA                       | (SEQ ID NO: 30)   |
| full | 210   | R7.0  | NG  | LSTAQVVAIASNGGGKQALEGIGEQLLKLRTAPYG                       | (SEQ ID NO: 31)   |
| full | 245   | R8.0  | SH  | LSTEQVVAIASSHGGKQALEAVRALFPDLRAAPYA                       | (SEQ ID NO: 32)   |
| full | 280   | R9.0  | NP  | LSTAQLVAIASNPGGKQALEAVRALFRELRAAPYA                       | (SEQ ID NO: 33)   |
| full | 315   | R10.0 | NH  | LSTEQVVAIASNHGGKQALEAVRALFRELRAAPYA                       | (SEQ ID NO: 34)   |
| full | 350   | R11.0 | NH  | LSTEQVVAIASNHGGKQALEAVRALFRGLRAAPYG                       | (SEQ ID NO: 35)   |
| full | 385   | R12.0 | SN  | LSTAQVVAIASSNGGKQALEAVWALLPVLRATPYD                       | (SEQ ID NO: 36)   |
| full | 420   | R13.0 | HY  | LNTAQVVAIASHYGGKPALEAVWAKLPVLRGVPYA                       | (SEQ ID NO: 37)   |
| half | 455   | R13.5 | IS  | LSTAQVVAIACISG-QQALEAIEAHMPTLRQAPH                        | (SEQ ID NO: 38)   |

TABLE 2-continued

Comparison of TALE DNA binding domains from two TALE from *Ralstonia*

| Type | Start | Name | RVD | Repeat Sequence | |
|---|---|---|---|---|---|
| | | | | TALE ABO27068.1 (4.5 repeats) | |
| full | 0 | R1.0 | NP | LSTAQLVAIASNPGGKQALEAVRAPFREVRAAPYA | (SEQ ID NO: 39) |
| full | 35 | R2.0 | NH | LSPEQVVAIASNHGGKQALEAVRALFRGLRAAPYG | (SEQ ID NO: 40) |
| full | 70 | R3.0 | SN | LSTAQVVAIASSNGGKQALEAVWALLPVLRATPYD | (SEQ ID NO: 41) |
| full | 105 | R4.0 | HD | LSTAQVVAIASHDGGKPALEAVWAKLPVLRGAPYA | (SEQ ID NO: 42) |
| half | 140 | R4.5 | IS | LSTAQVVAIACISG-QQALEAIEAHMPTLRQAPH | (SEQ ID NO: 43) |

Additional examples of TALE type proteins from Ralstonia include ABO27069.1 (10.5 repeats), ABO27070.1 (11.5 repeats), ABO27071.1 (7.5 repeats), ABO27072.1 (3.5 repeats), etc.

The DNA-binding polypeptides comprising TALE-repeat domains as described herein may also include additional TALE polypeptide sequences, for example N-terminal (N-cap) sequences and, optionally, C-terminal (C-cap) sequences flanking the repeat domains. N-cap sequences may be naturally or non-naturally occurring sequences of any length sufficient to support the function (e.g., DNA-binding, cleavage, activation, etc.) of the DNA-binding polypeptide and fusion proteins comprising these TALE-repeat domain-containing DNA-binding polypeptides. In certain embodiments, the protein comprises an N-cap sequence comprising a fragment (truncation) of a region of a TALE protein N-terminal to the repeat domain (e.g., an N-cap sequence comprising at least 130 to 140 residues (e.g., 131, 132, 133, 134, 135, 136, 137, 138, 139 or 140 residues) of a TALE polypeptide N-terminal of the repeat domain). In other embodiments, the TALE-repeat domain polypeptides as described herein the protein comprises a C-cap sequence comprising a fragment (truncated) region of a TALE protein C-terminal to the repeat domain (e.g., an C-cap sequence comprising C−20 to C+28; C−20 to C+55, or C−20 to C+63). In certain embodiments, the C-cap sequence comprises a half-repeat (C−20 to C−1). The TALE DNA-binding polypeptides as described herein may include N-cap, C-cap sequences or both N-cap and C-cap sequences.

The complete protein sequences (including TALE repeat domains as well as N-terminal and C-terminal sequences) of the TALE repeats shown in Table 1 and 2 are shown below in Table 3. The TALE repeat sequences of Tables 1 and 2 are shown in bold.

TABLE 3 complete amino acid sequence for GenBank accession numbers AAA27592.1, AAA92974.1, ABO27067.1 and ABO27068.1.

AAA27592.1 (SEQ ID NO: 44)
MDPIRSRTPSPARELLPGPQPDGVQPTADRGVSPPAGGPLDGLPARRTMSRTRLP

SPPAPSPAFSAGSFSDLLRQFDPSLFNTSLFDSLPPFGAHHTEAATGEWDEVQSGLRAAD

APPPTMRVAVTAARPPRAKPAPRRRAAQPSDASPAAQVDLRTLGYSQQQQEKIKPKVRS

TVAQHHEALVGHGFTHAHIVALSQHPAALGTVAVKYQDMIAALPEATHEAIVGVGKQ

WSGARALEALLTVAGELRGPPLQLDTGQLLKIAKRGGVTAVEAVHAWRNALTGAPL

NLTPEQVVAIASNIGGKQALETVQALLPVLCQAHGLTPDQVVAIASNGGGKQALET

VQRLLPVLCQAHGLTPEQVVAIASNIGGKQALETVQRLLPVLCQAHGLTPEQVVAI

ASNIGGKQALETVQRLLPVLCQAHGLTPEQVVAIASNGGGKQALETVQRLLPVLC

QAHGLTPEQVVAIASNGGGKQALETVQRLLPVLCQAHGLI

AAA92974.1 (SEQ ID NO: 45)
MDPIRSRTPSPARELLPGPQPDRVQPTADRGGAPPAGGPLDGLPARRTMSRTRLP

SPPAPSPAFSAGSFSDLLRQFDPSLLDTSLLDSMPAVGTPHTAAAPAECDEVQSGLRAAD

DPPPTVRVAVTARPPRAKPAPRRRAAQPSDASPAAQVDLRTLGYSQQQQEKIKPKVRST

VAQHHEALVGHGFTHAHIVALSQHPAALGTVAVTYQDIIRALPEATHEDIVGVGKQWS

GARALEALLTEAGELRGPPLQLDTGQLLKIAKRGGVTAVEAVHAWRNALTGAPLNL

TPDQVVAIASNIGGNQALETVQRLLPVLCQAHGLTPDQVVAIASHGGGKQALETV

QRLLPVLCQAHGLTPDQVVAIASNIGGKQALATVQRLLPVLCQDHGLTPDQVVAIA

TABLE 3-continued complete amino acid sequence for GenBank accession numbers
AAA27592.1, AAA92974.1, ABO27067.1 and ABO27068.1.

SHGGGKQALETVQRLLPVLCQDHGLTPDQVVAIASNIGGKQALETVQRLLPVLCQ

DHGLTPDQVVAIASNIGGKQALETVQRLLPVLCQDHGLTPDQVVAIASNNGGKQA

LETVQRLLPVLCQTHGLTPDQVVAIANHDGGKQALETVQRLLPVLCQDHGLTPDQ

VVAIASNIGGKQALATVQRLLPVLCQAHGLTPDQVVAIASHDGGKQALETVQRLLP

VLCQDHGLTPDQVVAIASNNGGKQALETVQRLLPVLCQDHGLTPAQVVAIANHGG

GKQALETVQRLLPVLCQDHGLTPVQVVAIASNSGGKQALETVQRLLPVLCQDHGL

TPVQVVAIASNGGGKQALATVQRLLPVLCQDHGLTPVQVVAIASHDGGKQALETV

QRLLPVLCQDHGLTPDQVVAIASNGGKQALESIVAQLSRPDPALAALTNDHLVALA

CLGGRPALDAVKKGLPHAPELIRRINRRIPERTSHRVADLAHVVRVLGFFQSHSHPAQAF

DDAMTQFGMSRHGLAQLFRRVGVTELEARYGTLPPASQRWDRILQASGMKRVKPSPTS

AQTPDQASLHAFADSLERDLDAPSPMHEGDQTRASSRKRSRSDRAVTGPSTQQSFEVRV

PEQQDALHLPLSWRVKRPRTRIGGGLPDPGTPIAADLAASSTVMWEQDAAPFAGAADD

FPAFNEEELAWLMELLPQSGSVGGTI

ABO27068.1 (SEQ ID NO: 46)
LSTAQLVAIASNPGGKQALEAVRAPFREVRAAPYALSPEQVVAIASNHGGKQ

ALEAVRALFRGLRAAPYGLSTAQVVAIASSNGGKQALEAVWALLPVLRATPYDLST

AQVVAIASHDGGKPALEAVWAKLPVLRGAPYALSTAQVVAIACISGQQALEAIEAH

MPTLRQAPHS

ABO27067.1 (SEQ ID NO: 47)
LTPQQVVAIASNTGGKRALEAVCVQLPVLRAAPYRLSTEQVVAIASNKGGK

QALEAVKAHLLDLLGAPYVLDTEQVVAIASHNGGKQALEAVKADLLDLRGAPYAL

STEQVVAIASHNGGKQALEAVKADLLDLRGAPYALSTEQVVAIASHNGGKQALEA

VKAQLLDLRGAPYALSTAQVVAIASHNGGKQALEAVKAQLLDLRGAPYALSTAQV

VAIASNGGGKQALEGIGEQLLKLRTAPYG - [unknown sequence] -

LSTEQVVAIASSHGGKQALEAVRALFPDLRAAPYALSTAQLVAIASNPGGKQALEA

VRALFRELRAAPYALSTEQVVAIASNHGGKQALEAVRALFRELRAAPYALSTEQVV

AIASNHGGKQALEAVRALFRGLRAAPYGLSTAQVVAIASSNGGKQALEAVWALLP

VLRATPYDLNTAQVVAIASHYGGKPALEAVWAKLPVLRGVPYALSTAQVVAIACIS

GQQALEAIEAHMPTLRQAPHGLSPERVAAIACIGGRSAVEA

Artificial TALE proteins and TALE fusion proteins can be produced to bind to a novel sequence using natural or engineered TALE repeat units (see Boch et al, ibid and Morbitzer et al, (2010) *Proc. Natl. Acad. Sci. USA* 107(50):21617-21622). See, also e.g., WO 2010/079430. When this novel target sequence was inserted upstream of a reporter gene in plant cells, the researchers were able to demonstrate activation of the reporter gene. Artificial TALE fusions comprising the FokI cleavage domain can also cleave DNA in living cells (see Christin et al, ibid, Li et al (2011a) and (2011b) ibid, Cernak et al (2011) *Nucl. Acid. Res.* epub doi:10.1093/nar/gcr218.

An engineered TALE protein and TALE fusion protein can have a novel binding specificity, compared to a naturally-occurring TALE protein. Engineering methods include, but are not limited to, rational design and various types of selection. Rational design includes, for example, using databases comprising nucleotide sequences for modules for single or multiple TALE repeats. Exemplary selection methods, including phage display and two-hybrid systems, are disclosed in U.S. Pat. Nos. 5,789,538; 5,925,523; 6,007,988; 6,013,453; 6,410,248; 6,140,466; 6,200,759; and 6,242,568; as well as WO 98/37186; WO 98/53057; WO 00/27878; WO 01/88197 and GB 2,338,237. In naturally occurring TALE proteins, only a limited repertoire of potential dipeptide motifs are typically employed. Thus, as described herein, TALE related domains containing all possible mono- and di-peptide sequences have been constructed and assembled into candidate TALE proteins. Thus, in certain embodiments, one or more TALE-repeat units of the DNA-binding protein comprise atypical RVDs.

Additionally, in naturally occurring TALE proteins of the same species, the repeat units often show little variability within the framework sequence (i.e. the residue(s) not involved in direct DNA contact (non-RVD residues). This lack of variability may be due to a number of factors including evolutionary relationships between individual TALE repeat units and protein folding requirements between adjacent repeats. Between differing phytopathogenicbacterial species however the framework sequences can vary. For example, the TALE repeat sequences in the *Xanthomonas campestris* pv vesicatoria, the protein AvrBs3 has less than 40% homology with brg11 and hpx17 repeat units from Ralstonia solanacearum (see Heuer et al (2007) *Appl Environ Micro* 73 (13): 4379-4384). The TALE repeat may be under stringent functional selection in each bacterium's natural environment, e.g., from the sequence of the genes in the host plant that the TALE regulates. Thus, as described herein, variants in the TALE framework (e.g., within the TALE repeat unit or sequences outside the repeat units such as N-cap and C-cap sequences) may be introduced by targeted or random mutagenesis by various methods know in the art, and the resultant TALE fusion proteins screened for optimal activity.

Multi TALE repeat modules may also be useful not only for assembling the DNA binding domains (comprising at least one TALE repeat unit) as described above, but also may be useful for the assembly of mini-TALE multimers (i.e. trimers, tetramers, pentamers etc.), wherein spanning linkers that also functioned as capping regions between the mini-TALE DNA binding domains would allow for base skipping and may result in higher DNA binding specificity. The use of linked mini-TALE DNA binding domains would relax the requirement for strict functional modularity at the level of individual TALE repeats and allows for the development of more complex and/or specific DNA recognition schemes wherein amino acids from adjacent motifs within a given module might be free to interact with each other for cooperative recognition of a desired DNA target sequence. Mini-TALE DNA binding domains could be linked and expressed using a suitable selection system (i.e. phage display) with randomized dipeptide motifs (or any other identified key positions) and selected based on their nucleic acid binding characteristics. Alternatively, multi-TALE repeat modules may be used to create an archive of repeat modules to allow for rapid construction of any specific desired TALE-fusion protein.

Selection of target sites and methods for design and construction of fusion proteins (and polynucleotides encoding same) are known to those of skill in the art and described in detail in U.S. Patent Application Publication Nos. 20050064474 and 20060188987, incorporated by reference in their entireties herein.

Artificial fusion proteins linking TALE DNA binding domains to zinc finger DNA binding domains may also be produced. These fusions may also be further linked to a desired functional domain.

In addition, as disclosed in these and other references, TALE DNA binding domains and/or zinc finger domains may be linked together using any suitable linker sequences, including for example, linkers of 5 or more amino acids in length (e.g., TGEKP (SEQ ID NO:48), TGGQRP (SEQ ID NO:49), TGQKP (SEQ ID NO:50), and/or TGSQKP (SEQ ID NO:51)), although it is likely that sequences that can function as capping sequence (N-cap and C-cap sequences) would be required at the interface between the TALE repeat domain and the linker. Thus, when linkers are used, linkers of five or more amino acids can be used in conjunction with the cap sequences to join the TALE DNA binding domains to a desired fusion partner domain. See, also, U.S. Pat. Nos. 6,479,626; 6,903,185; and 7,153,949 for exemplary linker sequences 6 or more amino acids in length. In addition, linkers between the TALE repeat domains and the fused functional protein domains can be constructed to be either flexible or positionally constrained to allow for the most efficient genomic modification. Linkers of varying lengths and compositions may be tested.

Fusion Proteins

Fusion proteins comprising DNA-binding proteins (e.g., TALE-fusion proteins) as described herein and a heterologous regulatory or functional domain (or functional fragment thereof) are also provided. Common domains include, e.g., transcription factor domains (activators, repressors, co-activators, co-repressors), nuclease domains, silencer domains, oncogene domains (e.g., myc, jun, fos, myb, max, mad, rel, ets, bcl, myb, mos family members etc.); DNA repair enzymes and their associated factors and modifiers; DNA rearrangement enzymes and their associated factors and modifiers; chromatin associated proteins and their modifiers (e.g. kinases, acetylases and deacetylases); and DNA modifying enzymes (e.g., methyltransferases, topoisomerases, helicases, ligases, kinases, phosphatases, polymerases, endonucleases), DNA targeting enzymes such as transposons, integrases, recombinases and resolvases and their associated factors and modifiers, nuclear hormone receptors, nucleases (cleavage domains or half-domains) and ligand binding domains. Other fusion proteins may include reporter or selection markers. Examples of reporter domains include GFP, GUS and the like. Reporters with specific utility in plant cells include GUS.

Suitable domains for achieving activation include the HSV VP16 activation domain (see, e.g., Hagmann et al., *J. Virol.* 71, 5952-5962 (1997)) nuclear hormone receptors (see, e.g., Torchia et al., *Curr. Opin. Cell. Biol.* 10:373-383 (1998)); the p65 subunit of nuclear factor kappa B (Bitko & Barik, *J. Virol.* 72:5610-5618 (1998) and Doyle & Hunt, *Neuroreport* 8:2937-2942 (1997)); Liu et al., *Cancer Gene Ther.* 5:3-28 (1998)), or artificial chimeric functional domains such as VP64 (Beerli et al., (1998) *Proc. Natl. Acad. Sci. USA* 95:14623-33), and degron (Molinari et al., (1999) *EMBO J.* 18, 6439-6447). Additional exemplary activation domains include, Oct 1, Oct-2A, Sp1, AP-2, and CTF1 (Seipel et al., *EMBO J.* 11, 4961-4968 (1992) as well as p300, CBP, PCAF, SRC1 PvALF, AtHD2A and ERF-2. See, for example, Robyr et al. (2000) *Mol. Endocrinol.* 14:329-347; Collingwood et al. (1999) *J. Mol. Endocrinol.* 23:255-275; Leo et al. (2000) *Gene* 245:1-11; Manteuffel-Cymborowska (1999) *Acta Biochim. Pol.* 46:77-89; McKenna et al. (1999) *J. Steroid Biochem. Mol. Biol.* 69:3-12; Malik et al. (2000) *Trends Biochem. Sci.* 25:277-283; and Lemon et al. (1999) *Curr. Opin. Genet. Dev.* 9:499-504. Additional exemplary activation domains include, but are not limited to, OsGAI, HALF-1, C1, AP1, ARF-5,-6,-7, and -8, CPRF1, CPRF4, MYC-RP/GP, and TRAB1. See, for example, Ogawa et al. (2000) *Gene* 245:21-29; Okanami et al. (1996) *Genes Cells* 1:87-99; Goff et al. (1991) *Genes Dev.* 5:298-309; Cho et al. (1999) *Plant Mol. Biol.* 40:419-429; Ulmason et al. (1999) *Proc. Natl. Acad. Sci. USA* 96:5844-5849; Sprenger-Haussels et al. (2000) *Plant J.* 22:1-8; Gong et al. (1999) *Plant Mol. Biol.* 41:33-44; and Hobo et al. (1999) *Proc. Natl. Acad. Sci. USA* 96:15,348-15,353.

It will be clear to those of skill in the art that, in the formation of a fusion protein (or a nucleic acid encoding same) between a DNA-binding domain as described herein and a functional domain, either an activation domain or a molecule that interacts with an activation domain is suitable as a functional domain. Essentially any molecule capable of recruiting an activating complex and/or activating activity (such as, for example, histone acetylation) to the target gene is useful as an activating domain of a fusion protein. Insulator domains, localization domains, and chromatin remodeling proteins such as ISWI-containing domains and/or methyl binding domain proteins suitable for use as functional domains in fusion molecules are described, for example, in co-owned U.S. Patent Applications 2002/0115215 and 2003/0082552 and in co-owned WO 02/44376.

Exemplary repression domains include, but are not limited to, KRAB A/B, KOX, TGF-beta-inducible early gene (TIEG), v-erbA, SID, MBD2, MBD3, members of the DNMT family (e.g., DNMT1, DNMT3A, DNMT3B), Rb, and MeCP2. See, for example, Bird et al. (1999) *Cell* 99:451-454; Tyler et al. (1999) *Cell* 99:443-446; Knoepfler et al. (1999) *Cell* 99:447-450; and Robertson et al. (2000) *Nature Genet.* 25:338-342. Additional exemplary repression domains include, but are not limited to, ROM2 and AtHD2A. See, for example, Chem et al. (1996) *Plant Cell* 8:305-321; and Wu et al. (2000) *Plant J.* 22:19-27.

In certain embodiments, the target site bound by the TALE-fusion protein is present in an accessible region of cellular chromatin. Accessible regions can be determined as described, for example, in co-owned International Publication WO 01/83732. If the target site is not present in an accessible region of cellular chromatin, one or more accessible regions can be generated as described in co-owned WO 01/83793. In additional embodiments, the DNA-binding domain of a fusion molecule is capable of binding to cellular chromatin regardless of whether its target site is in an accessible region or not. For example, such DNA-binding domains are capable of binding to linker DNA and/or nucleosomal DNA. Examples of this type of "pioneer" DNA binding domain are found in certain steroid receptor and in hepatocyte nuclear factor 3 (HNF3). Cordingley et al. (1987) *Cell* 48:261-270; Pina et al. (1990) *Cell* 60:719-731; and Cirillo et al. (1998) *EMBO J.* 17:244-254.

The fusion molecule may be formulated with a pharmaceutically acceptable carrier, as is known to those of skill in the art. See, for example, Remington's Pharmaceutical Sciences, 17th ed., 1985; and co-owned WO 00/42219.

The functional component/domain of a fusion molecule can be selected from any of a variety of different components capable of influencing transcription of a gene once the fusion molecule binds to a target sequence via its DNA binding domain. Hence, the functional component can include, but is not limited to, various transcription factor domains, such as activators, repressors, co-activators, co-repressors, and silencers.

Additional exemplary functional domains are disclosed, for example, in co-owned U.S. Pat. No. 6,534,261 and US Patent Application Publication No. 2002/0160940.

Functional domains that are regulated by exogenous small molecules or ligands may also be selected. For example, RheoSwitch® technology may be employed wherein a functional domain only assumes its active conformation in the presence of the external RheoChem™ ligand (see for example US 20090136465). Thus, the TALE-fusion protein may be operably linked to the regulatable functional domain wherein the resultant activity of the TALE-fusion protein is controlled by the external ligand.

In certain embodiments, the TALE DNA-binding proteins, or fragments thereof, are used as nucleases via fusion (N- and/or C-terminal to the TALE-repeat domain, N-cap and/or C-cap sequences) of a TALE DNA-binding domain to at least one nuclease (cleavage domain, cleavage half-domain). The cleavage domain portion of the fusion proteins disclosed herein can be obtained from any endonuclease or exonuclease. Exemplary endonucleases from which a cleavage domain can be derived include, but are not limited to, restriction endonucleases and homing endonucleases. See, for example, 2002-2003 Catalogue, New England Biolabs, Beverly, M A; and Belfort et al. (1997) *Nucleic Acids Res.* 25:3379-3388. Additional enzymes which cleave DNA are known (e.g., S1 Nuclease; mung bean nuclease; pancreatic DNase I; micrococcal nuclease; yeast HO endonuclease; see also Linn et al. (eds.) *Nucleases*, Cold Spring Harbor Laboratory Press, 1993). One or more of these enzymes (or functional fragments thereof) can be used as a source of cleavage domains and cleavage half-domains.

Similarly, a cleavage half-domain can be derived from any nuclease or portion thereof, as set forth above, that requires dimerization for cleavage activity. In general, two fusion proteins are required for cleavage if the fusion proteins comprise cleavage half-domains. Alternatively, a single protein comprising two cleavage half-domains can be used. The two cleavage half-domains can be derived from the same endonuclease (or functional fragments thereof), or each cleavage half-domain can be derived from a different endonuclease (or functional fragments thereof). In addition, the target sites for the two fusion proteins are preferably disposed, with respect to each other, such that binding of the two fusion proteins to their respective target sites places the cleavage half-domains in a spatial orientation to each other that allows the cleavage half-domains to form a functional cleavage domain, e.g., by dimerizing. Thus, in certain embodiments, the near edges of the target sites are separated by 5-8 nucleotides or by 15-18 nucleotides. However any integral number of nucleotides or nucleotide pairs can intervene between two target sites (e.g., from 2 to 50 nucleotide pairs or more). In general, the site of cleavage lies between the target sites.

Restriction endonucleases (restriction enzymes) are present in many species and are capable of sequence-specific binding to DNA (at a recognition site), and cleaving DNA at or near the site of binding. Certain restriction enzymes (e.g., Type IIS) cleave DNA at sites removed from the recognition site and have separable binding and cleavage domains. For example, the Type IIS enzyme FokI catalyzes double-stranded cleavage of DNA, at 9 nucleotides from its recognition site on one strand and 13 nucleotides from its recognition site on the other. See, for example, U.S. Pat. Nos. 5,356,802; 5,436,150 and 5,487,994; as well as Li et al. (1992) *Proc. Natl. Acad. Sci. USA* 89:4275-4279; Li et al. (1993) *Proc. Natl. Acad. Sci. USA* 90:2764-2768; Kim et al. (1994a) *Proc. Natl. Acad. Sci. USA* 91:883-887; Kim et al. (1994b) *J. Biol. Chem.* 269:31,978-31,982. Thus, in one embodiment, fusion proteins comprise the cleavage domain (or cleavage half-domain) from at least one Type IIS restriction enzyme and one or more TALE DNA-binding domains, which may or may not be engineered.

Exemplary Type IIS restriction enzymes, whose cleavage domains are separable from the binding domain, include FokI and BfiI (see Zaremba et al, (2004) *J Mol Biol.* 336(1):81-92). Fok enzyme is active as a dimer (see Bitinaite et al. (1998) *Proc. Natl. Acad. Sci. USA* 95: 10,570-10,575). For targeted double-stranded cleavage and/or targeted replacement of cellular sequences using TALE repeat domain-FokI fusions (or variants thereof further comprising a C-cap and an N-cap), two fusion proteins, each comprising a FokI cleavage half-domain, can be used to reconstitute a catalytically active cleavage domain. Alternatively, a single polypeptide molecule containing a TALE-repeat domain and two FokI cleavage half-domains can also be used. Another preferred Type IIS restriction enzyme is BfiI (see Zaremba et al, (2004) *J Mol Biol.* 336(1):81-92). The cleavage domain of this enzyme may be separated from its DNA binding domain and operably linked to a TALE DNA binding domain to create a TALEN.

A cleavage domain or cleavage half-domain can be any portion of a protein that retains cleavage activity, or that retains the ability to multimerize (e.g., dimerize) to form a functional cleavage domain.

Exemplary Type IIS restriction enzymes are described in International Publication WO 07/014,275, incorporated herein in its entirety. Additional restriction enzymes also contain separable binding and cleavage domains, and these are contemplated by the present disclosure. See, for example, Roberts et al. (2003) *Nucleic Acids Res.* 31:418-420.

To enhance cleavage specificity, in certain embodiments, the cleavage domain comprises one or more engineered cleavage half-domain (also referred to as dimerization domain mutants) that minimize or prevent homodimerization, as described, for example, in U.S. Patent Publication Nos. 20050064474; 20060188987; 20080131962; 20090311787; 20090305346; 20110014616; and 20110201055, the disclosures of all of which are incorporated by reference in their entireties herein. Amino acid residues at positions 446, 447, 479, 483, 484, 486, 487, 490, 491, 496, 498, 499, 500, 531, 534, 537, and 538 of FokI are all targets for influencing dimerization of the FokI cleavage half-domains.

Exemplary engineered cleavage half-domains of FokI that form obligate heterodimers include a pair in which a first cleavage half-domain includes mutations at amino acid residues at positions 490 and 538 of FokI and a second cleavage half-domain includes mutations at amino acid residues 486 and 499.

Additional engineered cleavage half-domains of FokI form an obligate heterodimers can also be used in the fusion proteins described herein. The first cleavage half-domain includes mutations at amino acid residues at positions 490 and 538 of FokI and the second cleavage half-domain includes mutations at amino acid residues 486 and 499.

Thus, in one embodiment, a mutation at 490 replaces Glu (E) with Lys (K); the mutation at 538 replaces Iso (I) with Lys (K); the mutation at 486 replaced Gln (Q) with Glu (E); and the mutation at position 499 replaces Iso (I) with Lys (K). Specifically, the engineered cleavage half-domains described herein were prepared by mutating positions 490 (E→K) and 538 (I→K) in one cleavage half-domain to produce an engineered cleavage half-domain designated "E490K:I538K" and by mutating positions 486 (Q→E) and 499 (I→L) in another cleavage half-domain to produce an engineered cleavage half-domain designated "Q486E:I499L". The engineered cleavage half-domains described herein are obligate heterodimer mutants in which aberrant cleavage is minimized or abolished. See, e.g., Example 1 of U.S. Patent Publication No. 2008/0131962, the disclosure of which is incorporated by reference in its entirety for all purposes.

The engineered cleavage half-domains described herein are obligate heterodimer mutants in which aberrant cleavage is minimized or abolished. See, e.g., Example 1 of WO 07/139,898. In certain embodiments, the engineered cleavage half-domain comprises mutations at positions 486, 499 and 496 (numbered relative to wild-type FokI), for instance mutations that replace the wild type Gln (Q) residue at position 486 with a Glu (E) residue, the wild type Iso (I) residue at position 499 with a Leu (L) residue and the wild-type Asn (N) residue at position 496 with an Asp (D) or Glu (E) residue (also referred to as a "ELD" and "ELE" domains, respectively). In other embodiments, the engineered cleavage half-domain comprises mutations at positions 490, 538 and 537 (numbered relative to wild-type FokI), for instance mutations that replace the wild type Glu (E) residue at position 490 with a Lys (K) residue, the wild type Iso (I) residue at position 538 with a Lys (K) residue, and the wild-type His (H) residue at position 537 with a Lys (K) residue or a Arg (R) residue (also referred to as "KKK" and "KKR" domains, respectively). In other embodiments, the engineered cleavage half-domain comprises mutations at positions 490 and 537 (numbered relative to wild-type FokI), for instance mutations that replace the wild type Glu (E) residue at position 490 with a Lys (K) residue and the wild-type His (H) residue at position 537 with a Lys (K) residue or a Arg (R) residue (also referred to as "KIK" and "KIR" domains, respectively). (See U.S. Patent Publication 20110201055). In addition, the FokI nuclease domain variants including mutations known as "Sharkey" or "Sharkey' (Sharkey prime)" mutations may be used (see Guo et al, (2010) *J. Mol. Biol.* doi:10.1016/j.jmb.2010.04.060).

Engineered cleavage half-domains described herein can be prepared using any suitable method, for example, by site-directed mutagenesis of wild-type cleavage half-domains (Fok I) as described in U.S. Patent Publication Nos. 20050064474, 20070134796; 20080131962.

TALE-fusion polypeptides and nucleic acids can be made using routine techniques in the field of recombinant genetics. Basic texts disclosing the general methods of use in this invention include Sambrook et al., Molecular Cloning, A Laboratory Manual (2nd ed. 1989); Kriegler, Gene Transfer and Expression: A Laboratory Manual (1990); and Current Protocols in Molecular Biology (Ausubel et al., eds., 1994)). In addition, essentially any nucleic acid can be custom ordered from any of a variety of commercial sources. Similarly, peptides and antibodies can be custom ordered from any of a variety of commercial sources.

Two alternative methods are typically used to create the coding sequences required to express newly designed DNA-binding peptides. One protocol is a PCR-based assembly procedure that utilizes overlapping oligonucleotides. These oligonucleotides contain substitutions primarily, but not limited to, positions 12 and 13 on the repeated domains making them specific for each of the different DNA-binding domains. Additionally, amino acid substitutions may be made at positions 4, 11 and 32. Amino acid substitutions may also be made at positions 2, 3, 4, 21, 23, 24, 25, 27, 30, 31, 33, 34 and/or 35 within one repeat unit. In some embodiments, the repeat unit contains a substitution in one position, and in others, the repeat unit contains from 2 to 18 amino acid substitutions. In some embodiments, the nucleotide sequence of the repeat units may be altered without altering the amino acid sequence.

Any suitable method of protein purification known to those of skill in the art can be used to purify TALE-fusion proteins of the invention (see Ausubel, supra, Sambrook, supra). In addition, any suitable host can be used, e.g., bacterial cells, insect cells, yeast cells, mammalian cells, and the like.

Thus, fusion molecules are constructed by methods of cloning and biochemical conjugation that are well known to those of skill in the art. Fusion molecules comprise a DNA-binding domain and a functional domain (e.g., a transcriptional activation or repression domain). Fusion molecules also optionally comprise nuclear localization signals (such as, for example, that from the SV40 medium T-antigen) and epitope tags (such as, for example, FLAG and hemagglutinin). Fusion proteins (and nucleic acids encoding them) are designed such that the translational reading frame is preserved among the components of the fusion. The fusion proteins as described herein may include one or more functional domains at the N- and/or C-terminus of the DNA-binding polypeptides as described herein.

Fusions between a polypeptide component of a functional domain (or a functional fragment thereof) on the one hand, and a non-protein DNA-binding domain (e.g., antibiotic, intercalator, minor groove binder, nucleic acid) on the other, are constructed by methods of biochemical conjugation known to those of skill in the art. See, for example, the Pierce Chemical Company (Rockford, Ill.) Catalogue. Methods and compositions for making fusions between a minor groove binder and a polypeptide have been described. Mapp et al. (2000) *Proc. Natl. Acad. Sci. USA* 97:3930-3935.

Additional Methods for Targeted Cleavage

Any nuclease having a target site in any desired gene(s) can be used in the methods disclosed herein. For example, homing endonucleases and meganucleases have very long recognition sequences, some of which are likely to be present, on a statistical basis, once in a human-sized genome. Any such nuclease having a target site in a desired gene can be used instead of, or in addition to, a TALE-repeat domain nuclease fusion, including for example, a zinc finger nuclease and/or a meganuclease, for targeted cleavage.

In certain embodiments, the nuclease is a meganuclease (homing endonuclease). Naturally-occurring meganucleases recognize 15-40 base-pair cleavage sites and are commonly grouped into four families: the LAGLIDADG family, ("LAGLIDADG" disclosed as SEQ ID NO: 125), the GIY-YIG family, the His-Cyst box family and the HNH family. Exemplary homing endonucleases include I-SceI, I-CeuI, PI-PspI, PI-Sce, I-SceIV, I-CsmI, I-PanI, I-SceII, I-PpoI, I-SceIII, I-CreI, I-TevI, I-TevII and I-TevIII. Their recognition sequences are known. See also U.S. Pat. No. 5,420,032; 6,833,252; Belfort et al. (1997) *Nucleic Acids Res.* 25:3379-3388; Dujon et al. (1989) *Gene* 82:115-118; Perler et al. (1994) *Nucleic Acids Res.* 22, 1125-1127; Jasin (1996) *Trends Genet.* 12:224-228; Gimble et al. (1996) *J. Mol. Biol.* 263:163-180; Argast et al. (1998) *J. Mol. Biol.* 280:345-353 and the New England Biolabs catalogue.

DNA-binding domains from naturally-occurring meganucleases, primarily from the LAGLIDADG family, ("LAGLIDADG" disclosed as SEQ ID NO: 125), have been used to promote site-specific genome modification in plants, yeast, Drosophila, mammalian cells and mice, but this approach has been limited to the modification of either homologous genes that conserve the meganuclease recognition sequence (Monet et al. (1999), *Biochem. Biophysics. Res. Common.* 255: 88-93) or to pre-engineered genomes into which a recognition sequence has been introduced (Route et al. (1994), *Mol. Cell. Biol.* 14: 8096-106; Chilton et al. (2003), *Plant Physiology.* 133: 956-65; Puchta et al. (1996), *Proc. Natl. Acad. Sci. USA* 93: 5055-60; Rong et al. (2002), *Genes Dev.* 16: 1568-81; Gouble et al. (2006), *J. Gene Med.* 8(5):616-622). Accordingly, attempts have been made to engineer meganucleases to exhibit novel binding specificity at medically or biotechnologically relevant sites (Porteus et al. (2005), *Nat. Biotechnol.* 23: 967-73; Sussman et al. (2004), *J. Mol. Biol.* 342: 31-41; Epinat et al. (2003), *Nucleic Acids Res.* 31: 2952-62; Chevalier et al. (2002) *Molec. Cell* 10:895-905; Epinat et al. (2003) *Nucleic Acids Res.* 31:2952-2962; Ashworth et al. (2006) *Nature* 441:656-659; Paques et al. (2007) *Current Gene Therapy* 7:49-66; U.S. Patent Publication Nos. 20070117128; 20060206949; 20060153826; 20060078552; and 20040002092).

Delivery

The TALE-fusion proteins, polynucleotides encoding same and compositions comprising the proteins and/or polynucleotides described herein may be delivered to a target cell by any suitable means, including, for example, by injection of mRNA encoding the TAL-fusion protein. See, Hammerschmidt et al. (1999) *Methods Cell Biol.* 59:87-115.

Methods of delivering proteins comprising engineered transcription factors are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties.

TALE-protein fusions as described herein may also be delivered using vectors containing sequences encoding one or more of the TALE-protein fusions. Any vector systems may be used including, but not limited to, plasmid vectors, retroviral vectors, lentiviral vectors, adenovirus vectors, poxvirus vectors; herpesvirus vectors and adeno-associated virus vectors, etc. See, also, U.S. Pat. Nos. 6,534,261; 6,607,882; 6,824,978; 6,933,113; 6,979,539; 7,013,219; and 7,163,824, incorporated by reference herein in their entireties. Furthermore, it will be apparent that any of these vectors may comprise one or more TALE-protein fusions encoding sequences. Thus, when one or more TALE-protein fusions (e.g., a pair of TALENs) are introduced into the cell, the TALE-protein fusions may be carried on the same vector or on different vectors. When multiple vectors are used, each vector may comprise a sequence encoding one or multiple TALE-protein fusions.

Conventional viral and non-viral based gene transfer methods can be used to introduce nucleic acids encoding engineered TALE-protein fusions in cells (e.g. mammalian cells) whole organisms or target tissues. Such methods can also be used to administer nucleic acids encoding TALE-protein fusions to cells in vitro. In certain embodiments, nucleic acids encoding TALE protein fusions are administered for in vivo or ex vivo uses. Non-viral vector delivery systems include DNA plasmids, naked nucleic acid, and nucleic acid complexed with a delivery vehicle such as a liposome or poloxamer. Viral vector delivery systems include DNA and RNA viruses, which have either episomal or integrated genomes after delivery to the cell. For a review of in vivo delivery of engineered DNA-binding proteins and fusion proteins comprising these binding proteins, see, e.g., Rebar (2004) *Expert Opinion Invest. Drugs* 13(7):829-839; Rossi et al. (2007) *Nature Biotech.* 25(12):1444-1454 as well as general gene delivery references such as Anderson, *Science* 256:808-813 (1992); Nabel & Felgner, *TIBTECH* 11:211-217 (1993); Mitani & Caskey, *TIBTECH* 11:162-166 (1993); Dillon, *TIBTECH* 11:167-175 (1993); Miller, *Nature* 357:455-460 (1992); Van Brunt, *Biotechnology* 6(10):1149-1154 (1988); Vigne, *Restorative Neurology and Neuroscience* 8:35-36 (1995); Kremer & Perricaudet, *British Medical Bulletin* 51(1):31-44 (1995); Haddada et al., in *Current Topics in Microbiology and Immunology* Doerfler and Böhm (eds.) (1995); and Yu et al., *Gene Therapy* 1:13-26 (1994).

Non-viral vector delivery systems include electroporation, lipofection, microinjection, biolistics, virosomes, liposomes, immunoliposomes, polycation or lipid:nucleic acid conjugates, naked DNA, artificial virions, and agent-enhanced uptake of DNA. Sonoporation using, e.g., the Sonitron 2000 system (Rich-Mar) can also be used for delivery of nucleic acids. Viral vector delivery systems include DNA and RNA viruses, which have either episomal or integrated genomes after delivery to the cell. Additional exemplary nucleic acid delivery systems include those provided by Amaxa Biosystems (Cologne, Germany), Maxcyte, Inc. (Rockville, Md.), BTX Molecular Delivery Systems (Holliston, Mass.) and Copernicus Therapeutics Inc, (see for example U.S. Pat. No. 6,008,336). Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424, WO 91/16024. Delivery can be to cells (ex vivo administration) or target tissues (in vivo administration).

The preparation of lipid:nucleic acid complexes, including targeted liposomes such as immunolipid complexes, is well known to one of skill in the art (see, e.g., Crystal, *Science* 270:404-410 (1995); Blaese et al., *Cancer Gene Ther.* 2:291-297 (1995); Behr et al., *Bioconjugate Chem.* 5:382-389 (1994); Remy et al., *Bioconjugate Chem.* 5:647-654 (1994); Gao et al., *Gene Therapy* 2:710-722 (1995); Ahmad et al., *Cancer Res.* 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

Additional methods of delivery include the use of packaging the nucleic acids to be delivered into EnGeneIC delivery vehicles (EDVs). These EDVs are specifically delivered to target tissues using bispecific antibodies where one arm of the antibody has specificity for the target tissue and the other has specificity for the EDV. The antibody brings the EDVs to the target cell surface and then the EDV is brought into the cell by endocytosis. Once in the cell, the contents are released (see MacDiarmid et al (2009) *Nature Biotechnology* vol 27(7) p. 643).

Suitable cells include but are not limited to eukaryotic and prokaryotic cells and/or cell lines. Non-limiting examples of such cells or cell lines generated from such cells include COS, CHO (e.g., CHO-S, CHO-K1, CHO-DG44, CHO-DUXB11, CHO-DUKX, CHOK1SV), VERO, MDCK, WI38, V79, B14AF28-G3, BHK, HaK, NS0, SP2/0-Ag14, HeLa, HEK293 (e.g., HEK293-F, HEK293-H, HEK293-T), and perC6 cells as well as insect cells such as *Spodoptera fugiperda* (Sf), or fungal cells such as *Saccharomyces, Pichia* and *Schizosaccharomyces*. In certain embodiments, the cell line is a CHO-K1, MDCK or HEK293 cell line. Additionally, primary cells may be isolated and used ex vivo for reintroduction into the subject to be treated following treatment with the TALE-fusions. Suitable primary cells include peripheral blood mononuclear cells (PBMC), and other blood cell subsets such as, but not limited to, CD4+ T cells or CD8+ T cells. Suitable cells also include stem cells such as, by way of example, embryonic stem cells, induced pluripotent stem cells, hematopoietic stem cells, neuronal stem cells, mesenchymal stem cells, muscle stem cells and skin stem cells.

Stem cells that have been modified may also be used in some embodiments. For example, stem cells that have been made resistant to apoptosis may be used as therapeutic compositions where the stem cells also contain the TALE-fusion proteins of the invention. Resistance to apoptosis may come about, for example, by knocking out BAX and/or BAK using BAX- or BAK-specific TALENs in the stem cells, or those that are disrupted in a caspase, again using caspase-6 specific TALENs for example.

Methods for introduction of DNA into hematopoietic stem cells are disclosed, for example, in U.S. Pat. No. 5,928,638. Vectors useful for introduction of transgenes into hematopoietic stem cells, e.g., CD34+ cells, include adenovirus Type 35.

Vectors suitable for introduction of polynucleotides as described herein include described herein include non-integrating lentivirus vectors (IDLV). See, for example, Ory et al. (1996) *Proc. Natl. Acad. Sci. USA* 93:11382-11388; Dull et al. (1998) *J. Virol.* 72:8463-8471; Zuffery et al. (1998) *J. Virol.* 72:9873-9880; Follenzi et al. (2000) *Nature Genetics* 25:217-222; U.S. Patent Publication No 2009/054985. As noted above, the disclosed methods and compositions can be used in any type of cell. Progeny, variants and derivatives of animal cells can also be used.

DNA constructs may be introduced into (e.g., into the genome of) a desired plant host by a variety of conventional techniques. For reviews of such techniques see, for example, Weissbach & Weissbach *Methods for Plant Molecular Biology* (1988, Academic Press, N.Y.) Section VIII, pp. 421-463; and Grierson & Corey, *Plant Molecular Biology* (1988, 2d Ed.), Blackie, London, Ch. 7-9.

For example, the DNA construct may be introduced directly into the genomic DNA of the plant cell using techniques such as electroporation and microinjection of plant cell protoplasts, or the DNA constructs can be introduced directly to plant tissue using biolistic methods, such as DNA particle bombardment (see, e.g., Klein et al (1987) *Nature* 327:70-73). Alternatively, the DNA constructs may be combined with suitable T-DNA flanking regions and introduced into a conventional *Agrobacterium tumefaciens* host vector. *Agrobacterium tumefaciens*-mediated transformation techniques, including disarming and use of binary vectors, are well described in the scientific literature. See, for example Horsch et al (1984) *Science* 233:496-498, and Fraley et al (1983) *Proc. Nat'l. Acad. Sci. USA* 80:4803.

In addition, gene transfer may be achieved using non-Agrobacterium bacteria or viruses such as *Rhizobium* sp. NGR234, *Sinorhizoboium meliloti, Mesorhizobium loti*, potato virus X, cauliflower mosaic virus and cassava vein mosaic virus and/or tobacco mosaic virus, See, e.g., Chung et al. (2006) *Trends Plant Sci.* 11(1):1-4.

The virulence functions of the *Agrobacterium tumefaciens* host will direct the insertion of the construct and adjacent marker into the plant cell DNA when the cell is infected by the bacteria using binary T DNA vector (Bevan (1984) *Nuc. Acid Res.* 12:8711-8721) or the co-cultivation procedure (Horsch et al (1985) *Science* 227:1229-1231). Generally, the *Agrobacterium* transformation system is used to engineer dicotyledonous plants (Bevan et al (1982) *Ann. Rev. Genet* 16:357-384; Rogers et al (1986) *Methods Enzymol.* 118:627-641). The *Agrobacterium* transformation system may also be used to transform, as well as transfer, DNA to monocotyledonous plants and plant cells. See U.S. Pat. No. 5,591,616; Hernalsteen et al (1984) *EMBO J* 3:3039-3041; Hooykass-Van Slogteren et al (1984) *Nature* 311:763-764; Grimsley et al (1987) *Nature* 325:1677-179; Boulton et al (1989) *Plant Mol. Biol.* 12:31-40; and Gould et al (1991) *Plant Physiol.* 95:426-434.

Alternative gene transfer and transformation methods include, but are not limited to, protoplast transformation through calcium-, polyethylene glycol (PEG)- or electroporation-mediated uptake of naked DNA (see Paszkowski et al. (1984) *EMBO J* 3:2717-2722, Potrykus et al. (1985) *Molec. Gen. Genet.* 199:169-177; Fromm et al. (1985) *Proc. Nat. Acad. Sci. USA* 82:5824-5828; and Shimamoto (1989) *Nature* 338:274-276) and electroporation of plant tissues (D'Halluin et al. (1992) *Plant Cell* 4:1495-1505). Additional methods for plant cell transformation include microinjection, silicon carbide mediated DNA uptake (Kaeppler et al. (1990) *Plant Cell Reporter* 9:415-418), and microprojectile bombardment (see Klein et al. (1988) *Proc. Nat. Acad. Sci. USA* 85:4305-4309; and Gordon-Kamm et al. (1990) *Plant Cell* 2:603-618).

Organisms

The methods and compositions described herein are applicable to any organism in which it is desired to regulate gene expression and/or alter the organism through genomic modification, including but not limited to eukaryotic organisms such as plants, animals (e.g., mammals such as mice, rats, primates, farm animals, rabbits, etc.), fish, and the like. Eukaryotic (e.g., yeast, plant, fungal, piscine and mammalian cells such as feline, canine, murine, bovine, ovine, and porcine) cells can be used. Cells from organisms containing one or more homozygous KO loci as described herein or other genetic modifications can also be used.

Exemplary mammalian cells include any cell or cell line of the organism of interest, for example oocytes, K562 cells, CHO (Chinese hamster ovary) cells, HEP-G2 cells, BaF-3 cells, Schneider cells, COS cells (monkey kidney cells expressing SV40 T-antigen), CV-1 cells, HuTu80 cells, NTERA2 cells, NB4 cells, HL-60 cells and HeLa cells, 293 cells (see, e.g., Graham et al. (1977) *J. Gen. Virol.* 36:59), and myeloma cells like SP2 or NS0 (see, e.g., Galfre and Milstein (1981) *Meth. Enzymol.* 73(B):3 46). Peripheral blood mononucleocytes (PBMCs) or T-cells can also be used, as can embryonic and adult stem cells. For example, stem cells that can be used include embryonic stem cells (ES), induced pluripotent stem cells (iPSC), mesenchymal stem cells, hematopoietic stem cells, liver stem cells, skin stem cells and neuronal stem cells.

Exemplary target plants and plant cells include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); vegetative crops for consumption (e.g. soybean and other legumes, squash, peppers, eggplant, celery etc), flowering plants (e.g., petunia, rose, chrysanthemum), conifers and pine trees (e.g., pine fir, spruce); poplar trees (e.g. *P. tremula×P. alba*); fiber crops (cotton, jute, flax, bamboo) plants used in phytoremediation (e.g., heavy metal accumulating plants); oil crops (e.g., sunflower, rape seed) and plants used for experimental purposes (e.g., *Arabidopsis*). Thus, the disclosed methods and compositions have use over a broad range of plants, including, but not limited to, species from the genera *Asparagus, Avena, Brassica, Citrus, Citrullus, Capsicum, Cucurbita, Daucus, Erigeron, Glycine, Gossypium, Hordeum, Lactuca, Lolium, Lycopersicon, Malus, Manihot, Nicotiana, Orychophragmus, Oryza, Persea, Phaseolus, Pisum, Pyrus, Prunus, Raphanus, Secale, Solanum, Sorghum, Triticum, Vitis, Vigna*, and *Zea*. The term plant cells include isolated plant cells as well as whole plants or portions of whole plants such as seeds, callus, leaves, roots, etc. The present disclosure also encompasses seeds of the plants described above wherein the seed has the transgene or gene construct and/or has been modified using the compositions and/or methods described herein. The present disclosure further encompasses the progeny, clones, cell lines or cells of the transgenic plants described above wherein said progeny, clone, cell line or cell has the transgene or gene construct.

Algae are being increasingly utilized for manufacturing compounds of interest, i.e. biofuels, plastics, hydrocarbons etc. Exemplary algae species include microalgae including diatoms and cyanobacteria as well as *Botryococcus braunii, Chlorella, Dunaliella tertiolecta, Gracileria, Pleurochrysis carterae, Sorgassum* and *Ulva*.

Assays for Determining Regulation of Gene Expression by TALE fusion proteins

A variety of assays can be used to determine the level of gene expression regulation by TALE-fusion proteins. The activity of a particular TALE-fusion proteins can be assessed using a variety of in vitro and in vivo assays, by measuring, e.g., protein or mRNA levels, product levels, enzyme activity, tumor growth; transcriptional activation or repression of a reporter gene; second messenger levels (e.g., cGMP, cAMP, IP3, DAG, Ca.sup.2+); cytokine and hormone production levels; and neovascularization, using, e.g., immunoassays (e.g., ELISA and immunohistochemical assays with antibodies), hybridization assays (e.g., RNase protection, northerns, in situ hybridization, oligonucleotide array studies), colorimetric assays, amplification assays, enzyme activity assays, tumor growth assays, phenotypic assays, and the like.

TALE-fusion proteins are typically first tested for activity in vitro using cultured cells, e.g., 293 cells, CHO cells, VERO cells, BHK cells, HeLa cells, COS cells, plant cell lines, plant callous cultures and the like. Preferably, human cells are used. The TALE-fusion protein is often first tested using a transient expression system with a reporter gene, and then regulation of the target endogenous gene is tested in cells and in animals, both in vivo and ex vivo. The TALE fusion proteins can be recombinantly expressed in a cell, recombinantly expressed in cells transplanted into an animal or plant, or recombinantly expressed in a transgenic animal or plant, as well as administered as a protein to an animal, plant or cell using delivery vehicles described herein. The cells can be immobilized, be in solution, be injected into an animal, or be naturally occurring in a transgenic or non-transgenic animal.

Modulation of gene expression is tested using one of the in vitro or in vivo assays described herein. Samples or assays are treated with a TALE-fusion proteins and compared to control samples without the test compound, to examine the extent of modulation.

The effects of the TALE-fusion proteins can be measured by examining any of the parameters described above. Any suitable gene expression, phenotypic, or physiological change can be used to assess the influence of a TALE-fusion protein. When the functional consequences are determined using intact cells or animals, one can also measure a variety of effects such as tumor growth, neovascularization, hormone release, transcriptional changes to both known and uncharacterized genetic markers (e.g., northern blots or oligonucleotide array studies), changes in cell metabolism such as cell growth or pH changes, and changes in intracellular second messengers such as cGMP.

Preferred assays for TALE-fusion protein mediated regulation of endogenous gene expression can be performed in vitro. In one preferred in vitro assay format, TALE-fusion protein mediated regulation of endogenous gene expression in cultured cells is measured by examining protein production using an ELISA assay. The test sample is compared to control cells treated with an empty vector or an unrelated TALE-fusion protein that is targeted to another gene.

In another embodiment, TALE-fusion protein-mediated regulation of endogenous gene expression is determined in vitro by measuring the level of target gene mRNA expression. The level of gene expression is measured using amplification, e.g., using PCR, LCR, or hybridization assays, e.g., northern hybridization, RNase protection, dot blotting. RNase protection is used in one embodiment. The level of protein or mRNA is detected using directly or indirectly labeled detection agents, e.g., fluorescently or radioactively labeled nucleic acids, radioactively or enzymatically labeled antibodies, and the like, as described herein.

Alternatively, a reporter gene system can be devised using the target gene promoter operably linked to a reporter gene such as luciferase, green fluorescent protein, CAT, or beta-gal. The reporter construct is typically co-transfected into a cultured cell. After treatment with the TALE-fusion proteins of choice, the amount of reporter gene transcription, translation, or activity is measured according to standard techniques known to those of skill in the art.

Another example of a preferred assay format useful for monitoring TALE-fusion protein mediated regulation of endogenous gene expression is performed in vivo. This assay is particularly useful for examining TALE-fusions that inhibit expression of tumor promoting genes, genes involved in tumor support, such as neovascularization (e.g., VEGF), or that activate tumor suppressor genes such as p53. In this assay, cultured tumor cells expressing the TALE-fusions of choice are injected subcutaneously into an immune compromised mouse such as an athymic mouse, an irradiated mouse, or a SCID mouse. After a suitable length of time, preferably 4-8 weeks, tumor growth is measured, e.g., by volume or by its two largest dimensions, and compared to the control. Tumors that have statistically significant reduction (using, e.g., Student's T test) are said to have inhibited growth. Alternatively, the extent of tumor neovascularization can also be measured. Immunoassays using endothelial cell specific antibodies are used to stain for vascularization of the tumor and the number of vessels in the tumor. Tumors that have a statistically significant reduction in the number of vessels (using, e.g., Student's T test) are said to have inhibited neovascularization.

Transgenic and non-transgenic plants or animals as described above are also used as a preferred embodiment for examining regulation of endogenous gene expression in vivo. Transgenic organisms typically express the TALE-fusions of choice. Alternatively, organisms that transiently express the TALE-fusions of choice, or to which the TALE fusion proteins have been administered in a delivery vehicle, can be used. Regulation of endogenous gene expression is tested using any one of the assays described herein.

Nucleic Acids Encoding TALE-fusion proteins

Conventional viral and non-viral based gene transfer methods can be used to introduce nucleic acids encoding engineered TALE domain fusions in mammalian cells, in whole organisms or in target tissues. Such methods can be used to administer nucleic acids encoding TALE domain fusions to cells in vitro. Preferably, the nucleic acids encoding TALE domain fusions are administered for in vivo or ex vivo uses. Non-viral vector delivery systems include DNA plasmids, naked nucleic acid, and nucleic acid complexed with a delivery vehicle such as a liposome. Viral vector delivery systems include DNA and RNA viruses, which have either episomal or integrated genomes after delivery to the cell. For a review of gene therapy procedures, see Anderson, *Science* 256:808-813 (1992); Nabel & Felgner, *TIBTECH* 11:211-217 (1993); Mitani & Caskey, *TIBTECH* 11:162-166 (1993); Dillon, *TIBTECH* 11:167-175 (1993); Miller, *Nature* 357:455-460 (1992); Van Brunt, *Biotechnology* 6(10):1149-1154 (1988); Vigne, *Restorative Neurology and Neuroscience* 8:35-36 (1995); Kremer & Perricaudet, *British Medical Bulletin* 51(1):31-44 (1995); Haddada et al., in *Current Topics in Microbiology and Immunology* Doerfler and Bohm (eds) (1995); and Yu et al., *Gene Therapy* 1:13-26 (1994).

The use of RNA or DNA viral based systems for the delivery of nucleic acids encoding engineered TALE domain fusions takes advantage of highly evolved processes for targeting a virus to specific cells in the body and trafficking the viral payload to the nucleus. Viral vectors can be administered directly to patients (in vivo) or they can be used to treat cells in vitro and the modified cells are administered to patients (ex vivo). Conventional viral based systems for the delivery of TALE domain fusions could include retroviral, lentivirus, adenoviral, adeno-associated and herpes simplex virus vectors, for gene transfer. Viral vectors are currently the most efficient and versatile method of gene transfer in target cells and tissues. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vector that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., *J. Virol.* 66:2731-2739 (1992); Johann et al., *J. Virol.* 66:1635-1640 (1992); Sommerfelt et al, *Virol.* 176:58-59 (1990); Wilson et al., *J. Virol.* 63:2374-2378 (1989); Miller et al., *J. Virol.* 65:2220-2224 (1991); PCT/US94/05700).

In applications where transient expression of the TALE domain fusions is preferred, adenoviral based systems are typically used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors are also used to transduce cells with target nucleic acids, e.g., in the in vitro production of nucleic acids and peptides, and for in vivo and ex vivo gene therapy procedures (see, e.g., West et al., *Virology* 160:38-47 (1987); U.S. Pat. No. 4,797,368; WO 93/24641; Kotin, *Human Gene Therapy* 5:793-801 (1994); Muzyczka, *J. Clin. Invest.* 94:1351 (1994). Construction of recombinant AAV vectors are described in a number of publications, including U.S. Pat. No. 5,173,414; Tratschin et al., *Mol. Cell. Biol.* 5:3251-3260 (1985); Tratschin, et al., *Mol Cell. Biol.* 4:2072-2081 (1984); Hermonat & Muzyczka, *Proc Natl Acad Sci USA* 81:6466-6470 (1984); and Samulski et al., *J. Virol.* 63:03822-3828 (1989).

In particular, at least six viral vector approaches are currently available for gene transfer in clinical trials, with retroviral vectors by far the most frequently used system. All of these viral vectors utilize approaches that involve complementation of defective vectors by genes inserted into helper cell lines to generate the transducing agent.

pLASN and MFG-S are examples are retroviral vectors that have been used in clinical trials (Dunbar et al., *Blood* 85:3048-305 (1995); Kohn et al., *Nat. Med.* 1:1017-102 (1995); Malech et al., *Proc Natl Acad Sci USA* 94:22 12133-12138 (1997)). PA317/pLASN was the first therapeutic vector used in a gene therapy trial. (Blaese et al., *Science* 270: 475480 (1995)). Transduction efficiencies of 50% or greater have been observed for MFG-S packaged vectors. (Ellem et al., *Immunol Immunother.* 44(1):10-20 (1997); Dranoff et al., *Hum. Gene Ther.* 1:111-2 (1997).

Recombinant adeno-associated virus vectors (rAAV) are a promising alternative to gene delivery systems based on the defective and nonpathogenic parvovirus adeno-associated type 2 virus. All vectors are derived from a plasmid that retains only the AAV 145 bp inverted terminal repeats flanking the transgene expression cassette. Efficient gene transfer and stable transgene delivery due to integration into the genomes of the transduced cell are key features for this vector system. (Wagner et al., *Lancet* 351:9117 1702-3 (1998), Kearns et al., *Gene Ther.* 9:748-55 (1996)).

Replication-deficient recombinant adenoviral vectors (Ad) are predominantly used for colon cancer gene therapy, because they can be produced at high titer and they readily infect a number of different cell types. Most adenovirus vectors are engineered such that a transgene replaces the Ad E1a, E1b, and E3 genes; subsequently the replication defector vector is propagated in human 293 cells that supply deleted gene function in trans. Ad vectors can transduce multiply types of tissues in vivo, including nondividing, differentiated cells such as those found in the liver, kidney and muscle system tissues. Conventional Ad vectors have a large carrying capacity. An example of the use of an Ad vector in a clinical trial involved polynucleotide therapy for antitumor immunization with intramuscular injection (Sterman et al., *Hum. Gene Ther.* 7:1083-9 (1998)). Additional examples of the use of adenovirus vectors for gene transfer include Rosenecker et al, *Infection* 24:1 5-10 (1996); Sterman et al., *Hum. Gene Ther.* 9:7 1083-1089 (1998); Welsh et al., *Hum. Gene Ther.* 2:205-18 (1995); Alvarez et al., *Hum. Gene Ther.* 5:597-613 (1997); Topf et al., *Gene Ther.* 5:507-513 (1998); Sterman et al., *Hum. Gene Ther.* 7:1083-1089 (1998); U.S. Patent Publication No. 2008/0159996.

Packaging cells are used to form virus particles that are capable of infecting a host cell. Such cells include 293 cells, which package adenovirus, and psi2 cells or PA317 cells, which package retrovirus. Viral vectors used in gene therapy are usually generated by producer cell line that packages a nucleic acid vector into a viral particle. The vectors typically contain the minimal viral sequences required for packaging and subsequent integration into a host, other viral sequences being replaced by an expression cassette for the protein to be expressed. The missing viral functions are supplied in trans by the packaging cell line. For example, AAV vectors used in gene therapy typically only possess ITR sequences from the AAV genome, which are required for packaging and integration into the host genome. Viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV.

In many gene therapy applications, it is desirable that the gene therapy vector be delivered with a high degree of specificity to a particular tissue type. A viral vector is typically modified to have specificity for a given cell type by expressing a ligand as a fusion protein with a viral coat protein on the viruses outer surface. The ligand is chosen to have affinity for a receptor known to be present on the cell type of interest. For example, Han et al., *Proc Natl Acad Sci USA* 92:9747-9751 (1995), reported that Moloney murine leukemia virus can be modified to express human heregulin fused to gp70, and the recombinant virus infects certain human breast cancer cells expressing human epidermal growth factor receptor. This principle can be extended to other pairs of virus, expressing a ligand fusion protein and target cell expressing a receptor. For example, filamentous phage can be engineered to display antibody fragments (e.g., FAB or Fv) having specific binding affinity for virtually any chosen cellular receptor. Although the above description applies primarily to viral vectors, the same principles can be applied to nonviral vectors. Such vectors can be engineered to contain specific uptake sequences thought to favor uptake by specific target cells.

Gene therapy vectors can be delivered in vivo by administration to an individual patient, typically by systemic administration (e.g., intravenous, intraperitoneal, intramuscular, subdermal, or intracranial infusion) or topical application, as described below. Alternatively, vectors can be delivered to cells ex vivo, such as cells explanted from an individual patient (e.g., lymphocytes, bone marrow aspirates, tissue biopsy) or universal donor hematopoietic stem cells, followed by reimplantation of the cells into a patient, usually after selection for cells which have incorporated the vector.

Ex vivo cell transfection for diagnostics, research, or for gene therapy (e.g., via re-infusion of the transfected cells into the host organism) is well known to those of skill in the art. In a preferred embodiment, cells are isolated from the subject organism, transfected with a TALE fusion nucleic acid (gene or cDNA), and re-infused back into the subject organism (e.g., patient). Various cell types suitable for ex vivo transfection are well known to those of skill in the art (see, e.g., Freshney et al., Culture of Animal Cells, A Manual of Basic Technique (3rd ed. 1994)) and the references cited therein for a discussion of how to isolate and culture cells from patients).

In one embodiment, stem cells are used in ex vivo procedures for cell transfection and gene therapy. The advantage to using stem cells is that they can be differentiated into other cell types in vitro, or can be introduced into a mammal (such as the donor of the cells) where they will engraft in the bone marrow. Methods for differentiating CD34+ cells in vitro into clinically important immune cell types using cytokines such a GM-CSF, IFN-.gamma. and TNF-alpha are known (see Inaba et al., *J. Exp. Med.* 176:1693-1702 (1992)).

Stem cells are isolated for transduction and differentiation using known methods. For example, stem cells are isolated from bone marrow cells by panning the bone marrow cells with antibodies which bind unwanted cells, such as CD4+ and CD8+ (T cells), CD45+ (panb cells), GR-1 (granulocytes), and Iad (differentiated antigen presenting cells) (see Inaba et al., *J. Exp. Med.* 176:1693-1702 (1992)). Exemplary stem cells include human embryonic stem cells (hES), induced pluripotent stem cells (iPSC), hematopoietic stem cells, mesenchymal stem cells, neuronal stem cells, and muscle stem cells.

Vectors (e.g., retroviruses, adenoviruses, liposomes, etc.) containing therapeutic TALE domain fusion nucleic acids can be also administered directly to the organism for transduction of cells in vivo. Alternatively, naked DNA can be administered. Administration is by any of the routes normally used for introducing a molecule into ultimate contact with blood or tissue cells. Suitable methods of administering such nucleic acids are available and well known to those of skill in the art, and, although more than one route can be used to administer a particular composition, a particular route can often provide a more immediate and more effective reaction than another route.

Pharmaceutically acceptable carriers are determined in part by the particular composition being administered, as well as by the particular method used to administer the composition. Accordingly, there is a wide variety of suitable formulations of pharmaceutical compositions of the present invention, as described below (see, e.g., Remington's Pharmaceutical Sciences, 17th ed., 1989).

Pharmaceutical Compositions and Administration

TALE-fusions and expression vectors encoding TALE fusions can be administered directly to the patient for modulation of gene expression and for therapeutic or prophylactic applications, for example, cancer, ischemia, diabetic retinopathy, macular degeneration, rheumatoid arthritis, psoriasis, HIV infection, sickle cell anemia, Alzheimer's disease, muscular dystrophy, neurodegenerative diseases, vascular disease, cystic fibrosis, stroke, and the like. Examples of microorganisms that can be inhibited by TALE fusion protein gene therapy include pathogenic bacteria, e.g., chlamydia, rickettsial bacteria, mycobacteria, staphylococci, streptococci, pneumococci, meningococci and conococci, klebsiella, proteus, serratia, pseudomonas, legionella, diphtheria, salmonella, bacilli, cholera, tetanus, botulism, anthrax, plague, leptospirosis, and Lyme disease bacteria; infectious fungus, e.g., *Aspergillus, Candida* species; protozoa such as sporozoa (e.g., *Plasmodia*), rhizopods (e.g., Entamoeba) and flagellates (*Trypanosoma, Leishmania, Trichomonas, Giardia*, etc.); viral diseases, e.g., hepatitis (A, B, or C), herpes virus (e.g. VZV, HSV-1, HSV-6, HSV-II, CMV, and EBV), HIV, Ebola, adenovirus, influenza virus, flaviviruses, echovirus, rhinovirus, coxsackie virus, comovirus, respiratory syncytial virus, mumps virus, rotavirus, measles virus, rubella virus, parvovirus, vaccinia virus, HTLV virus, dengue virus, papillomavirus, poliovirus, rabies virus, and arboviral encephalitis virus, etc.

Administration of therapeutically effective amounts is by any of the routes normally used for introducing TALE-fusions into ultimate contact with the tissue to be treated. The TALE-fusions are administered in any suitable manner, preferably with pharmaceutically acceptable carriers. Suitable methods of administering such modulators are available and well known to those of skill in the art, and, although more than one route can be used to administer a particular composition, a particular route can often provide a more immediate and more effective reaction than another route.

Formulations suitable for parenteral administration, such as, for example, by intravenous, intramuscular, intradermal, and subcutaneous routes, include aqueous and non-aqueous, isotonic sterile injection solutions, which can contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. In the practice of this invention, compositions can be administered, for example, by intravenous infusion, orally, topically, intraperitoneally, intravesically or intrathecally. The formulations of compounds can be presented in unit-dose or multi-dose sealed containers, such as ampules and vials. Injection solutions and suspensions can be prepared from sterile powders, granules, and tablets of the kind previously described.

Regulation of Gene Expression in Plants

TALE-fusions can be used to engineer plants for traits such as increased disease resistance, modification of structural and storage polysaccharides, flavors, proteins, and fatty acids, fruit ripening, yield, color, nutritional characteristics, improved storage capability, drought or submergence/flood tolerance, and the like. In particular, the engineering of crop species for enhanced oil production, e.g., the modification of the fatty acids produced in oilseeds, is of interest. See, e.g., U.S. Pat. No. 7,262,054; and U.S. Patent Publication Nos. 2008/0182332 and 20090205083:

Seed oils are composed primarily of triacylglycerols (TAGs), which are glycerol esters of fatty acids. Commercial production of these vegetable oils is accounted for primarily by six major oil crops (soybean, oil palm, rapeseed, sunflower, cotton seed, and peanut.) Vegetable oils are used predominantly (90%) for human consumption as margarine, shortening, salad oils, and flying oil. The remaining 10% is used for non-food applications such as lubricants, oleochemicals, biofuels, detergents, and other industrial applications.

The desired characteristics of the oil used in each of these applications varies widely, particularly in terms of the chain length and number of double bonds present in the fatty acids making up the TAGs. These properties are manipulated by the plant in order to control membrane fluidity and temperature sensitivity. The same properties can be controlled using TALE domain fusions to produce oils with improved characteristics for food and industrial uses.

The primary fatty acids in the TAGs of oilseed crops are 16 to 18 carbons in length and contain 0 to 3 double bonds. Palmitic acid (16:0 [16 carbons: 0 double bonds]), oleic acid (18:1), linoleic acid (18:2), and linolenic acid (18:3) predominate. The number of double bonds, or degree of saturation, determines the melting temperature, reactivity, cooking performance, and health attributes of the resulting oil.

The enzyme responsible for the conversion of oleic acid (18:1) into linoleic acid (18:2) (which is then the precursor for 18:3 formation) is DELTA12-oleate desaturase, also referred to as omega-6 desaturase. A block at this step in the fatty acid desaturation pathway should result in the accumulation of oleic acid at the expense of polyunsaturates.

In one embodiment proteins containing TALE domain(s) are used to regulate expression of the FAD2-1 gene in soybeans. Two genes encoding microsomal DELTA.6 desaturases have been cloned recently from soybean, and are referred to as FAD2-1 and FAD2-2 (Heppard et al., *Plant Physiol.* 110:311-319 (1996)). FAD2-1 (delta 12 desaturase) appears to control the bulk of oleic acid desaturation in the soybean seed. TALE-fusions can thus be used to modulate gene expression of FAD2-1 in plants. Specifically, TALE domain fusions can be used to inhibit expression of the FAD2-1 gene in soybean in order to increase the accumulation of oleic acid (18:1) in the oil seed. Moreover, TALE-fusions can be used to modulate expression of any other plant gene, such as delta-9 desaturase, delta-12 desaturases from other plants, delta-15 desaturase, acetyl-CoA carboxylase, acyl-ACP-thioesterase, ADP-glucose pyrophosphorylase, starch synthase, cellulose synthase, sucrose synthase, senescence-associated genes, heavy metal chelators, fatty acid hydroperoxide lyase, polygalacturonase, EPSP synthase, plant viral genes, plant fungal pathogen genes, and plant bacterial pathogen genes.

Functional Genomics Assays

TALE-fusions also have use for assays to determine the phenotypic consequences and function of gene expression. The recent advances in analytical techniques, coupled with focussed mass sequencing efforts have created the opportunity to identify and characterize many more molecular targets than were previously available. This new information about genes and their functions will speed along basic biological understanding and present many new targets for therapeutic intervention. In some cases analytical tools have not kept pace with the generation of new data. An example is provided by recent advances in the measurement of global differential gene expression. These methods, typified by gene expression microarrays, differential cDNA cloning frequencies, subtractive hybridization and differential display methods, can very rapidly identify genes that are up or down-regulated in different tissues or in response to specific stimuli. Increasingly, such methods are being used to explore biological processes such as, transformation, tumor progression, the inflammatory response, neurological disorders etc. One can now very easily generate long lists of differentially expressed genes that correlate with a given physiological phenomenon, but demonstrating a causative relationship between an individual differentially expressed gene and the phenomenon is difficult. Until now, simple methods for assigning function to differentially expressed genes have not kept pace with the ability to monitor differential gene expression.

Using conventional molecular approaches, over expression of a candidate gene can be accomplished by cloning a full-length cDNA, subcloning it into a mammalian expression vector and transfecting the recombinant vector into an appropriate host cell. This approach is straightforward but labor intensive, particularly when the initial candidate gene is represented by a simple expressed sequence tag (EST). Under expression of a candidate gene by "conventional" methods is yet more problematic. Antisense methods and methods that rely on targeted ribozymes are unreliable, succeeding for only a small fraction of the targets selected. Gene knockout by homologous recombination works fairly well in recombinogenic stem cells but very inefficiently in somatically derived cell lines. In either case large clones of syngeneic genomic DNA (on the order of 10 kb) should be isolated for recombination to work efficiently.

The TALE-fusion technology can be used to rapidly analyze differential gene expression studies. Engineered TALE domain fusions can be readily used to up or down-regulate any endogenous target gene. Very little sequence information is required to create a gene-specific DNA binding domain. This makes the TALE domain fusions technology ideal for analysis of long lists of poorly characterized differentially expressed genes. One can simply build a TALE-based DNA-binding domain for each candidate gene, create chimeric up and down-regulating artificial transcription factors and test the consequence of up or down-regulation on the phenotype under study (transformation, response to a cytokine etc.) by switching the candidate genes on or off one at a time in a model system.

This specific example of using engineered TALE domain fusions to add functional information to genomic data is merely illustrative. Any experimental situation that could benefit from the specific up or down-regulation of a gene or genes could benefit from the reliability and ease of use of engineered TALE-fusions.

Additionally, greater experimental control can be imparted by TALE domain fusions than can be achieved by more conventional methods. This is because the production and/or function of an engineered TALE-fusions can be placed under small molecule control. Examples of this approach are provided by the Tet-On system, the ecdysone-regulated system and a system incorporating a chimeric factor including a mutant progesterone receptor. These systems are all capable of indirectly imparting small molecule control on any endogenous gene of interest or any transgene by placing the function and/or expression of a ZFP regulator under small molecule control.

Transgenic Organisms

A further application of the TALE-fusion technology is manipulating gene expression and/or altering the genome to produce transgenic animals or plants. As with cell lines, overexpression of an endogenous gene or the introduction of a heterologous gene to a transgenic animal, such as a transgenic mouse, is a fairly straightforward process. Similarly, production of transgenic plants is well known. The TALE domain fusions technology described herein can be used to readily generate transgenic animals and plants.

The use of engineered TALE domain fusions to manipulate gene expression can be restricted to adult animals using the small molecule regulated systems described in the previous section. Expression and/or function of a TALE domain-based repressor can be switched off during development and switched on of will in the adult animals. This approach relies on the addition of the TALE-fusions expressing module only; homologous recombination is not required. Because the TALE domain fusions repressors are trans dominant, there is no concern about germline transmission or homozygosity. These issues dramatically affect the time and labor required to go from a poorly characterized gene candidate (a cDNA or EST clone) to a mouse model. This ability can be used to rapidly identify and/or validate gene targets for therapeutic intervention, generate novel model systems and permit the analysis of complex physiological phenomena (development, hematopoiesis, transformation, neural function etc.) Chimeric targeted mice can be derived according to Hogan et al., Manipulating the Mouse Embryo: A Laboratory Manual, (1988); Teratocarcinomas and Embryonic Stem Cells: A Practical Approach, Robertson, ed., (1987); and Capecchi et al., *Science* 244:1288 (1989).

Genetically modified animals may be generated by deliver of the nucleic acid encoding the TALE fusion into a cell or an embryo. Typically, the embryo is a fertilized one cell stage embryo. Delivery of the nucleic acid may be by any of the methods known in the art including micro injection into the nucleus or cytoplasm of the embryo. TALE fusion encoding nucleic acids may be co-delivered with donor nucleic acids as desired. The embryos are then cultured as in known in the art to develop a genetically modified animal.

In one aspect of the invention, genetically modified animals in which at least one chromosomal sequence encoding a gene or locus of interest has been edited are provided. For example, the edited gene may become inactivated such that it is not transcribed or properly translated. Alternatively, the sequence may be edited such that an alternate form of the gene is expressed (e.g. insertion (knock in) or deletion (knock out) of one or more amino acids in the expressed protein). In addition, the gene of interest may comprise an inserted sequence such as a regulatory region. The genetically modified animal may be homozygous for the edited sequence or may be heterozygous. In some embodiments, the genetically modified animal may have sequence inserted (knocked in) in a 'safe harbor' locus such as the Rosa26, HPRT, CCR5 or AAVS1 (PPP1R12C) loci. These knock in animals may be additionally edited at other chromosomal loci. In some embodiments, the sequences of interest are inserted into the safe harbor without any selection markers, and/or without a promoter and so rely on the endogenous promoter to drive expression. In some aspects, the genetically modified animal may be "humanized" such that certain genes specific to the host species animal are replaced with the human homolog. In this way, genetically modified animals are produced with a human gene expressed (e.g. Factor IX) to allow for the development of an animal model system to study the human gene, protein or disease. In some embodiments, the gene of interest may further comprise a recombinase recognition site such as loxP or FRT for recognition of the cognate recombinase Cre and FLP, respectively, which can flank the inserted gene(s) of interest. Genes may be inserted containing the nuclease sites such that crossing the genetically modified animal with another genetically modified animal expressing the cognate recombinase (e.g Cre) will result in progeny that lack the inserted gene.

Applications

The disclosed methods and compositions can be used to control gene regulation at a desired locus. Genes of choice may be activated or repressed, depending on the transcriptional regulatory domain that is fused to the TALE-repeat domain. TALE activators may be targeted to pluripotency-inducing genes for the goal of producing iPSCs from differentiated cells. This may be of use for in vitro and in vivo model development for specific disease states and for developing cell therapeutics derived from iPSCs.

The TALE-fusions may be useful themselves as therapeutic agents, especially in immune privileged tissues such as in the brain or eye. Designed activators, for example, are especially useful for increasing the dose of a gene product that requires natural splice variant ratios for, proper function (e.g. VEGF), or for genes that are toxic where overexpressed. Transient exposure to designed TALE regulators may also allow permanent switching of gene expression status via the use of functional domain that impose epigenetic changes. This technology could provide additional utility for generating stem cells and controlling their differentiation pathways. Additionally, TALE-fusions may be of use in immunosuppressed patients.

The disclosed methods and compositions can also be used for genomic editing of any gene or genes. In certain applications, the methods and compositions can be used for inactivation of genomic sequences. To date, cleavage-based methods have been used to target modifications to the genomes of at least nine higher eukaryotes for which such capabilities were previously unavailable, including economically important species such as corn and rat. In other applications, the methods and compositions allow for generation of random mutations, including generation of novel allelic forms of genes with different expression or biological properties as compared to unedited genes or integration of humanized genes, which in turn allows for the generation of cell or animal models. In other applications, the methods and compositions can be used for creating random mutations at defined positions of genes that allows for the identification or selection of animals carrying novel allelic forms of those genes. In other applications, the methods and compositions allow for targeted integration of an exogenous (donor) sequence into any selected area of the genome. Regulatory sequences (e.g. promoters) could be integrated in a targeted fashion at a site of interest. By "integration" is meant both physical insertion (e.g., into the genome of a host cell) and, in addition, integration by copying of the donor sequence into the host cell genome via the specialized nucleic acid information exchange process that occurs during homology-directed DNA repair.

Donor sequences can also comprise nucleic acids such as shRNAs, miRNAs etc. These small nucleic acid donors can be used to study their effects on genes of interest within the genome. Genomic editing (e.g., inactivation, integration and/or targeted or random mutation) of an animal gene can be achieved, for example, by a single cleavage event, by cleavage followed by non-homologous end joining, by cleavage followed by homology-directed repair mechanisms, by cleavage followed by physical integration of a donor sequence, by cleavage at two sites followed by joining so as to delete the sequence between the two cleavage sites, by targeted recombination of a missense or nonsense codon into the coding region, by targeted recombination of an irrelevant sequence (i.e., a "stuffer" sequence) into the gene or its regulatory region, so as to disrupt the gene or regulatory region, or by targeting recombination of a splice acceptor sequence into an intron to cause mis-splicing of the transcript. In some applications, transgenes of interest may be integrated into a safe harbor locus within a mammalian or plant genome using TALEN-induced DSB at a specified location. See, U.S. Patent Publication Nos. 20030232410; 20050208489; 20050026157; 20050064474; 20060188987; 20060063231; and International Publication WO 07/014,275, the disclosures of which are incorporated by reference in their entireties for all purposes. These TALENs may also be supplied as components of kits for targeted genetic manipulation.

TALE-repeat domains, optionally with novel or atypical RVDs, and moreover optionally attached to N-cap and/or C-cap residues, can also be fused to DNA manipulating enzymes such as recombinases, transposases, resolvases or integrases. Thus these domains can be used to make targeted fusion proteins that would allow the development of such tools and/or therapeutics as targeted transposons and the like. Additionally, a TALE-repeat domain, optionally attached to N-cap and C-cap residues, may be fused to nuclease domains to create designer restriction enzymes. For example, a TALE-repeat domain, optionally attached to N-cap and C-cap residues, may be fused to a single-chain FokI domain (wherein two FokI cleavage half domains are joined together using a linker of choice) such that treatment of a DNA preparation with the nuclease fusion can allow cleavage to occur exactly at the desired location. This technology would be useful for cloning and manipulation of DNA sequences that are not readily approached with standard restriction enzymes. Such a system would also be useful in specialized cell systems used in manufacturing. For example, the CHO-derived cell lines do not have an endogenously active transposase/integrase system. TALE-transposase/integrase systems could be developed for specific targeting in CHO cells and could be useful for knock out/knock in, genome editing etc due to the highly specific nature of the TALE DNA binding domain.

TALE-fusion proteins can be used to prevent binding of specific DNA-binding proteins to a given locus. For example, a natural regulatory protein may be blocked from binding to its natural target in a promoter simply because an engineered TALE protein has been expressed in the host cell and it occupies the site on the DNA, thus preventing regulation by the regulatory protein.

TALE-fusion proteins may be engineered to bind to RNA. In this way, for example, splice donors and/or splice acceptor sites could be masked and would prevent splicing at specific locations in a mRNA. In other aspects, a TALE may be engineered to bind specific functional RNAs such as shRNAs, miRNA or RNAis, for example.

TALE fusion proteins can be useful in diagnostics. For example, the proteins may be engineered to recognize certain sequences in the genome to identify alleles known to be associated with a specific disease. For example, TALE-fusions with a specified number of TALE repeat units may be utilized as a "yard stick" of sorts to measure the number of trinucleotide repeats in patients with the potential of having a trinucleotide repeat disorder (e.g. Huntingdon's Disease) to determine the likelihood of becoming afflicted with one of these diseases or to prognosticate the severity of the symptoms. These fusion proteins may also be supplied as components of diagnostic kits to allow rapid identification of genomic markers of interest. Additionally, these proteins may be purified from cells and used in diagnostic kits or for diagnostic reagents for uses such as analyzing the allele type of a gene of interest, measuring mRNA expression levels etc. The TALE fusions may be attached to silicon chips or beads for multichannel or microfluidic analyses.

TALE fusions may be useful in manufacturing settings. TALE-transcription factor fusions or TALENs may be used in cell lines of interest (e.g. CHO cells) or in algae (e.g. for biofuel production).

There are a variety of applications for TALE fusion proteins mediated genomic editing of a gene or genomic loci. The methods and compositions described herein allow for the generation of models of human diseases and for plant crops with desired characteristics.

All publications and patent applications cited in this specification are herein incorporated by reference as if each individual publication or patent application were specifically and individually indicated to be incorporated by reference.

Although the foregoing invention has been described in some detail by way of illustration and example for purposes of clarity of understanding, it will be readily apparent to one of ordinary skill in the art in light of the teachings of this invention that certain changes and modifications may be made thereto without departing from the spirit or scope of the appended claims.

EXAMPLES

Example 1

Cloning of a Natural TALE from *Xanthomonas axonopodis*

To identify a natural TALE protein that could serve as an initial design framework, a canonical, natural TALE that both exhibited a high degree of specificity as well as evidence of target sequence binding in mammalian cells was identified. Specifically, a TALE protein containing 12.5 TALE repeats (12 full repeats and a half repeat referred to as TALE 13) was cloned from *Xanthomonas axonopodis* by PCR amplification using the following primer pair: pthA_d152N_EcoR, ACGTGGATTCATGGTGGATCTACGCACGCTC (SEQ ID NO:52) and pthA_Sac2_Rev, TACGTCCGCGGTCCTGAGGCAATAGCTCCATCA (SEQ ID NO:53) The primer pair was originally designed to amplify the AvrBs3 gene with the N-terminal 152 amino acids truncation. It has been previously shown that these sequences are necessary for transport into plant cells, but otherwise are dispensable for function (see Szurek et al (2002) *Mol. Micro* 46(1) p. 13-23). Several TALE proteins, characterized by the highly conserved sequences with the variation of the numbers of central tandem repeats, were isolated by PCR with these primer pairs. With the exception of TALE15, which has been reported as hssB3.0 (Shiotani et al (2007) *J. Bacteriol* 189 (8): 3271-9) the other TALE proteins isolated appear as novel proteins, as they have not been reported in the public literature. These include TALE13, TALE9, and TALE16, with 13, 9, and 16 TALE repeats, respectively.

Figure 1A:
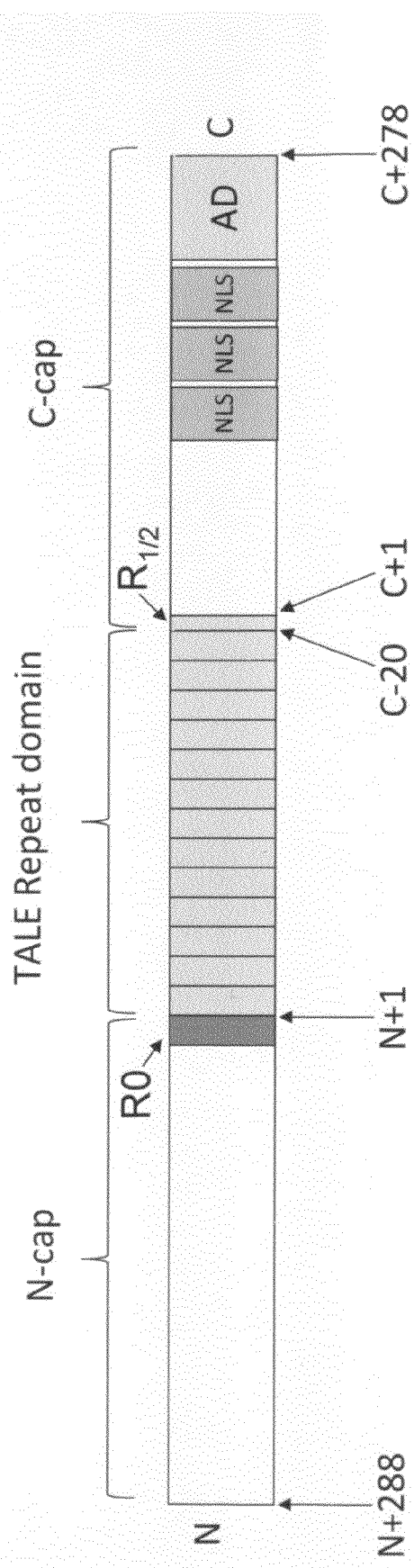
FIG. 1A shows a schematic of the domain structure of a TALE protein (not drawn to scale). 'N' and 'C' indicate the amino and carboxy termini, respectively. The TALE repeat domain, N-cap and C-cap are labeled and the residue numbering scheme for the N-cap and C-cap in this protein are indicated. "R0" represents the 34 amino acids preceding the first tandem TALE repeat that may share some structural homology with the TALE repeat units and that may specify thymine in a DNA target sequence. "$R_{1/2}$" denotes the C-terminal TALE "half-repeat," which is a 20 residue peptide sequence (with residues numbered from C−20 to C−1) with homology to the first 20 residues of a typical TALE repeat. NLS is the nuclear localization sequence. AD is the acidic activation domain.

The domain map of TALE13 (with the length of the N-cap inferred) is shown in FIG. 1A and the sequence indicating the domains and the amino acids that determine the DNA sequence that the protein interacts with are indicated in FIG. 1B, along with indicators of the positional numbering system used in this work.

Example 2

Truncation of TALE13 and Other TALEs and Effects on DNA Binding

As an initial investigation of the range of capping sequences that provide maximal activity, several truncations of the TALE were made. These truncations are shown below in Table 4.

TABLE 4

TALE truncation characteristics

| Clone number | N Term +288 to +138 | N Term +137 to +37 | R0 | Repeat units | R1/2 | Leucine rich region | Nuclear localization domain | Acidic domain |
|---|---|---|---|---|---|---|---|---|
| #1 | (−) | (+) | (+) | (+) | (+) | (+) | (+) | (+) |
| #2 | (−) | (+) | (+) | (+) | (+) | (+) | (−) | (−) |
| #3 | (−) | (+) | (+) | (+) | (+) | (−) | (−) | (−) |
| #4 | (−) | (−) | (+) | (+) | (+) | (+) | (−) | (−) |
| #5 | (−) | (−) | (−) | (+) | (+) | (−) | (−) | (−) |
| #6 | (−) | (+) | (+) | (+) | (+) | (+) | (−) | (−) |
| #7 | (−) | (+/−) | (+) | (+) | (+) | (+) | (−) | (−) |

Note:
(+) indicates the presence of the region while (−) indicates its absence

The regions of the truncations are numbered as follows: On the N-terminus, the end point is represented by a number that enumerates the number of amino acid residues in an N-terminal direction from the first base of the first true TALE repeat (see FIG. 1B). For example, a label of N+91 describes a truncation on the N-terminus that leaves intact the 91 amino acids in the N-terminal direction from the N-terminus of the first true repeat. On the C terminus, the end point is represented by the number of amino acids in the C-terminal direction from the last amino acid of the last full TALE repeat. Truncation #1, termed TALE-13, clone #1, has the N-terminal 152 amino acids of the full length TALE protein removed and a single methionine residue added to the resulting N terminus and thus has an N+137 endpoint (N-cap), making this clone approximately 2.5 kb in length. Truncation #2, also has the N-terminal 152 amino acids of the full length TALE protein removed, and a single methionine residue added to the resulting N-terminus and thus has an N+137 endpoint, as well as the C-terminal sequences downstream of the 5' edge of the NLS, making this clone approximately 2.0 kb in length. Truncation #3 is similar to clone #2 except that it has the leucine-rich region deleted (the leucine-rich region is C-terminal to the half-repeat and extends to C+52 of the C-cap), making this clone approximately 1.6 kb in length. Truncation #4 is similar to clone #2 except that on the N-terminus, it has been deleted all the way up and including the R0 repeat sequence, making this clone approximately 1.6 kb in length. Truncation #5 is similar to clone #4 except that its deletion on the C-terminal side includes the leucine-rich sequence (similar to clone #2), making this clone approximately 1.4 kb in length. The deduced target sequence of the full length TALE 13 protein is TATAAATACCTTCT (SEQ ID NO:54), although there has not yet been an endogenous target site identified for this protein. Truncation #6 has 152 amino acids deleted from the N-terminus and in the C-terminal regions is similar to clone #2 except that 43 additional amino acids have been deleted. Truncation #7 has 165 amino acids deleted from the N-terminus and has the same C-terminal deletion as clone #6. Truncations #6 and #7 are discussed below.

A standard SELEX assay was run on the truncated TALE proteins to identify the DNA sequence these proteins bind to (for SELEX methodology, see Perez, E. E. et al. *Nature Biotech.* 26, 808-816 (2008)), and the results are presented in Tables 5 and 6. The experiment presented in Table 5 was performed with target library N18TA. The N18TA library includes a DNA duplex with sequence:

N18TA:
(SEQ ID NO: 55)
5' CAGGGATCCATGCACTGTACGTTTNNNNNNNNNNNNNNNNNNAAACC

ACTTGACTGCGGATCCTGG 3', where N indicates a mixture of all four bases. Additional libraries (as indicated) include the following sequences:

-continued

N22AT:
(SEQ ID NO: 59)
5'CAGGGATCCATGCACTGTACGAAANNNNNNNNNNNNNNNNNNNNNTT

TCCACTTGACTGCGGATCCTGG 3'

N21TA:
(SEQ ID NO: 60)
5'CAGGGATCCATGCACTGTACGTTTNNNNNNNNNNNNNNNNNNNNNAAA

CCACTTGACTGCGGATCCTGG3'

N23TA:
(SEQ ID NO: 61)
5'CAGGGATCCATGCACTGTACGTTTNNNNNNNNNNNNNNNNNNNNNNA

AACCACTTGACTGCGGATCCTGG 3'

N26:
(SEQ ID NO: 126)
5'CAGGGATCCATGCACTGTACGTTNNNNNNNNNNNNNNNNNNNNNNNN

NAACCACTTGACTGCGGATCCTGG 3'

N30CG:
(SEQ ID NO: 62)
5'CAGGGATCCATGCACTGTACGCCCNNNNNNNNNNNNNNNNNNNNNNNN

NNNNNNGGGCCACTTGACTGCGGATCCTGG 3'

The data is presented below in Table 5 as a base frequency matrix. At each position in these matrices, the box indicates the expected RVD target base; numbers indicate the relative frequency of each recovered base type where 1.0 indicated 100%.

TABLE 5

SELEX results with TALE 13, clone #1

| | | | | | | | | | | | | | | | |
|---|---|---|---|---|---|---|---|---|---|---|---|---|---|---|---|
| | A | 0.00 | 0.95 | 0.00 | 0.95 | 0.95 | 0.95 | 0.00 | 0.95 | 0.05 | 0.00 | 0.00 | 0.00 | 0.00 | 0.00 |
| N18TA | C | 0.00 | 0.00 | 0.00 | 0.00 | 0.05 | 0.05 | 0.00 | 0.05 | 0.95 | 1.00 | 0.00 | 0.05 | 1.00 | 0.00 |
| | G | 0.00 | 0.00 | 0.00 | 0.05 | 0.00 | 0.00 | 0.00 | 0.00 | 0.00 | 0.00 | 0.00 | 0.00 | 0.00 | 0.05 |
| | T | 1.00 | 0.05 | 1.00 | 0.00 | 0.00 | 0.00 | 1.00 | 0.00 | 0.00 | 0.00 | 1.00 | 0.95 | 0.00 | 0.95 |

The TALE 13 clone #1 protein appears to be highly selective in its binding despite lacking the N-terminal 152 amino acids. The SELEX data for TALE 13, clone #2 is presented in Table 6. In this figure, the SELEX was repeated with two different libraries of target sequences, and gave similar results with both libraries.

TABLE 6

SELEX Results with TALE 13, clone #2

| | | | | | | | | | | | | | | | |
|---|---|---|---|---|---|---|---|---|---|---|---|---|---|---|---|
| | A | 0.00 | 0.94 | 0.00 | 0.75 | 0.88 | 1.00 | 0.00 | 0.98 | 0.00 | 0.00 | 0.00 | 0.00 | 0.02 | 0.00 |
| N18TA | C | 0.00 | 0.00 | 0.00 | 0.15 | 0.06 | 0.00 | 0.06 | 0.02 | 0.98 | 0.98 | 0.04 | 0.00 | 0.98 | 0.04 |
| | G | 0.00 | 0.04 | 0.02 | 0.10 | 0.02 | 0.00 | 0.00 | 0.00 | 0.00 | 0.00 | 0.00 | 0.00 | 0.00 | 0.00 |
| | T | 1.00 | 0.02 | 0.98 | 0.00 | 0.04 | 0.00 | 0.94 | 0.00 | 0.02 | 0.02 | 0.96 | 1.00 | 0.00 | 0.96 |

When clones #3, 4 and 5 were subjected to the SELEX procedure, no consensus sequences were detected. Thus it appears that the TALE binding domains require N- and C-terminal cap sequences comprised in from clone #2 to yield a consensus sequence in this assay. Additional truncations were made and tested for activity using a DNA binding ELISA assay essentially as described in Bartsevich et al., *Stem Cells.* 2003; 21:632-7. The truncations are presented below in Table 7, which also includes the ELISA results. The starting N-terminus in these truncations is at amino acid 152, identical to the N-terminus in the #1, #2, and #3 truncations discussed above. In this fine-scale truncation series, the end points are as follows.

TABLE 7

ELISA results on fine truncations of TALE13

| N-Cap | C-Cap | ELISA results (relative fluorescence units) |
|---|---|---|
| N + 137 | C + 52 | 56, 32 |
| N + 121 | C + 52 | 8, 9 |
| N + 111 | C + 52 | 10, 12 |
| N + 100 | C + 52 | 8, 9 |
| N + 91 | C + 52 | 9, 10 |
| N + 137 | C + 95 | 131, 82, 44 |
| N + 100 | C + 115 | 10, 14 |
| N + 91 | C + 115 | 12, 13 |
| N + 0 | C + 278 | 10 |
| N + 0 | C + 95 | 9 |
| N + 0 | C + 27 | 8 |
| N + 137 | C + 278 | 12 |
| N + 137 | C + 27 | 10 |

These data suggest that the efficient TALE binding in this in vitro assay requires residues from between N+122 and N+137 and also from between C+53 and C+95 (N-cap residues up to and including N+121 were not sufficient for robust binding and C-cap residues up to and including C+52 were not sufficient for robust binding).

The preliminary mapping studies allowed the estimation of the minimal N-cap and C-cap sequences of the *Xanthomonas* TALE to achieve optimal binding activity. For the N-terminal cap, it appears that the sequence comprising some number of amino acids between the N+122 and N+137 amino acids prior to the beginning to the first true repeat are required for DNA binding activity. Similar cap examples for the *Ralstonia* caps can be made based on structural homology to the *Xanthomonas* TALEs (see below in Table 8). In the C-terminal caps, the bold amino acids indicate the RVDs.

TABLE 8

Cap examples

| | Terminus | Position | Sequence |
|---|---|---|---|
| Xanthomonas | N-term | N+137 | MVDLRTLGYSQQQQEKIKPKVRSTVAQHHEALVGHGFTHAHIVALSQHPAA LGTVAVKYQDMIAALPEATHEAIVGVGKQWSGARALEALLTVAGELRGPPL QLDTGQLLKIAKRGGVTAVEAVHAWRNALTGAPLN (SEQ ID NO: 363) |
| | N-term | N+121 | IKPKVRSTVAQHHEALVGHGFTHAHIVALSQHPAALGTVAVKYQDMIAALP EATHEAIVGVGKQWSGARALEALLTVAGELRGPPLQLDTGQLLKIAKRGGV TAVEAVHAWRNALTGAPLN (SEQ ID NO: 364) |
| | C-term | C+52 | LTPEQVVAIASNGGGRPALESIVAQLSRPDPALAALTNDHLVALACLGGRP ALDAVKKGLPHAPALIKRTNR (SEQ ID NO: 365) |
| | C-term | C+31 | LTPEQVVAIASNGGGRPALESIVAQLSRPDPALAALTNDHL (SEQ ID NO: 366) |
| Ralstonia | N-term | Based on: YP_002253357.1 | LKQESLAEVAKYHATLAGQGFTHADICRISRRWQSLRVVANNYPELMAAL PRLTTAQIVDIARQRSGDLALQALLPVAAALTAAPLGLSASQIATVAQYGE RPAIQALYRLRRKLTRAPLG (SEQ ID NO: 367) |
| | C-term | YP_002253357.1 | LSIAQVIAIACIGGRQALTAIEMHMLALRAAPYNLSPERV (SEQ ID NO: 368) |

Example 3

Binding Specificity for Natural TALE Proteins 9 and 16

Two additional natural TALE proteins were subjected to the SELEX procedure to identify the target DNA sequences that these proteins bind. TALE 9 has 8.5 TALE repeats that specify the following DNA target: TANAAACCTT (SEQ ID NO:56), while TALE16 has 15.5 TALE repeats that predict the following target: TACACATCTTTAACACT (SEQ ID NO:57). The data are presented in Tables 9 and 10. In Table 9, the TALE 9 protein in the clone #2 configurations was used and the results are shown. As with TALE 13 clone #2, this experiment was repeated with a second partially randomized DNA library and gave similar data as the first library. As described above for TALE 13, TALE 9 is highly specific for its target sequence.

TABLE 9

SELEX results with TALE 9, clone #2

| | | | | | | | | | | | |
|---|---|---|---|---|---|---|---|---|---|---|---|
| N18TA | A | 0.00 | 0.98 | 0.00 | 0.98 | 0.98 | 1.00 | 0.00 | 0.00 | 0.00 | 0.00 |
| | C | 0.00 | 0.00 | 0.02 | 0.00 | 0.00 | 0.00 | 0.98 | 1.00 | 0.02 | 0.00 |
| | G | 0.00 | 0.02 | 0.00 | 0.02 | 0.02 | 0.00 | 0.00 | 0.00 | 0.00 | 0.00 |
| | T | 1.00 | 0.00 | 0.98 | 0.00 | 0.00 | 0.00 | 0.02 | 0.00 | 0.98 | 1.00 |

Table 10 shows the SELEX data for the TALE 16 protein with the N18TA library and again demonstrates a high degree of sequence specificity for the target identified.

TABLE 10

SELEX results with TALE 16, clone #2

| A | 0.00 | 0.95 | 0.05 | 0.95 | 0.00 | 0.95 | 0.00 | 0.60 | 0.00 | 0.00 | 0.00 | 1.00 | 0.95 | 0.00 | 0.95 | 0.05 | 0.00 |
|---|---|---|---|---|---|---|---|---|---|---|---|---|---|---|---|---|---|
| C | 0.00 | 0.00 | 0.95 | 0.05 | 1.00 | 0.00 | 0.00 | 0.40 | 0.05 | 0.25 | 0.00 | 0.00 | 0.00 | 0.95 | 0.00 | 0.95 | 0.00 |
| G | 0.00 | 0.00 | 0.00 | 0.00 | 0.00 | 0.05 | 0.05 | 0.00 | 0.15 | 0.00 | 0.00 | 0.00 | 0.00 | 0.05 | 0.05 | 0.00 | 0.00 |
| T | 1.00 | 0.05 | 0.00 | 0.00 | 0.00 | 0.00 | 0.95 | 0.00 | 0.80 | 0.75 | 1.00 | 0.00 | 0.05 | 0.00 | 0.00 | 0.00 | 1.00 |

Additional truncations were made in the TALE proteins to further investigate the conditions for efficient DNA binding. Table 4 above depicts these truncations. When TALE 9 was tested in the clone #6 truncation (Table 11) the DNA binding specificity was maintained (compare Table 11 with Table 9).

TABLE 11

SELEX results with TALE 9, clone #6

| | | | | | | | | | | | |
|---|---|---|---|---|---|---|---|---|---|---|---|
| N22TA | A | 0.04 | 0.96 | 0.00 | 0.83 | 0.96 | 0.83 | 0.00 | 0.00 | 0.00 | 0.00 |
| | C | 0.00 | 0.04 | 0.04 | 0.04 | 0.04 | 0.13 | 0.91 | 0.96 | 0.04 | 0.09 |
| | G | 0.04 | 0.00 | 0.04 | 0.00 | 0.00 | 0.00 | 0.04 | 0.00 | 0.04 | 0.00 |
| | T | 0.91 | 0.00 | 0.91 | 0.13 | 0.00 | 0.04 | 0.04 | 0.04 | 0.91 | 0.91 |

Example 4

Reporter Gene Activation by TALE-Fusion Proteins in Mammalian Cells

Figure 3:
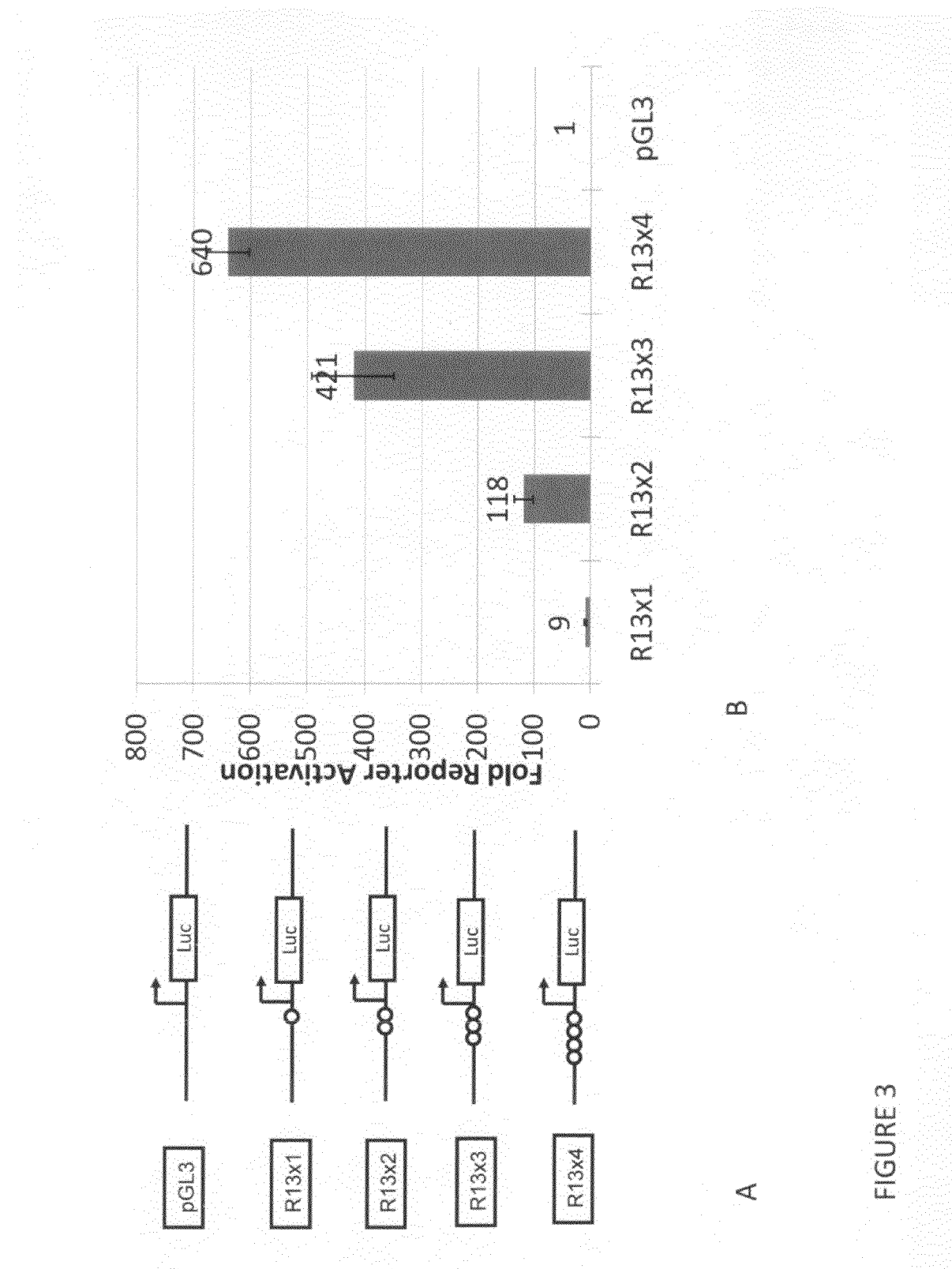
FIG. 3, panels A and B, show a schematic of the reporter construct containing 0-4 TR13 targets (FIG. 3A) and synergistic reporter gene activation by TALE13-VP16 fusion protein (TR13-VP16, TALE13 linked with an activation domain from VP16) on the luciferase reporter constructs containing 1 to 4 multiple TR13 targets, indicated as R13x1 to R13x4, respectively (FIG. 3B). pGL3 is the control reporter vector lacking any TR13 target elements.
Figure 4:
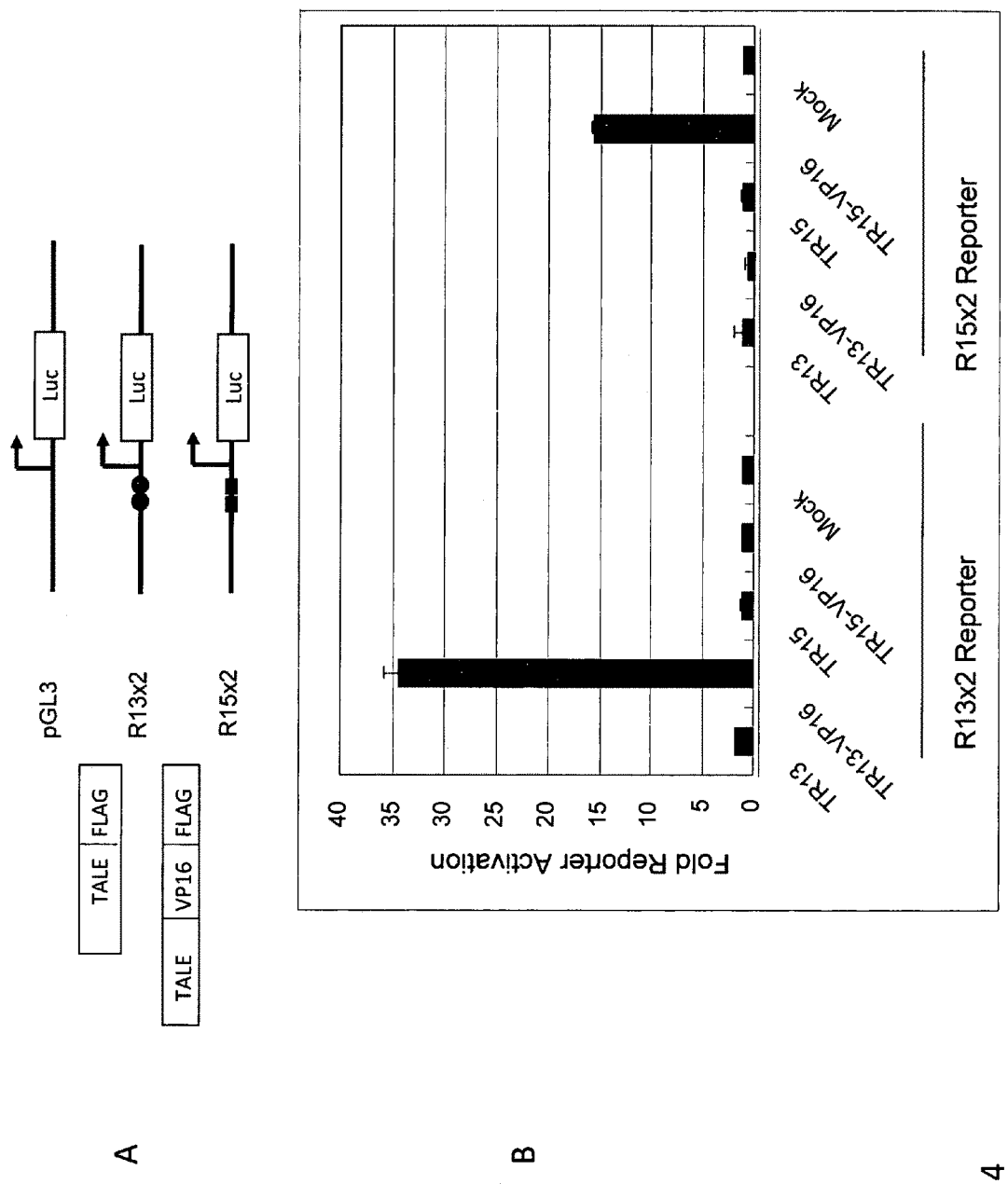
FIG. 4, panels A and B, show reporter gene activation by TALE VP16 fusion proteins.

To investigate the functional activity of the TALE domain fusions in mammalian cells, engineered reporter constructs were made as follows. One or more copies of the target sequences for the cloned TALE 13 or TALE 15 were inserted in a reporter construct between the NheI and Bgl II sites thereby placing the targets upstream from the firefly luciferase expression unit driven by the minimal SV40 promoter in the pGL3 plasmid (Promega) (see FIG. 2). The promoter region of the pGL3 plasmid is shown in FIG. 2A and the sequence containing the two predicted target sites for TALE13 is shown in FIG. 2B. In the experiment depicted in FIG. 3, the TALE protein construct, together with the reporter plasmid containing 2 targets (FIG. 3A), and an expression construct containing *Renilla* luciferase (Promega) as an internal control, were co-transfected into human 293 cells. The firefly luciferase activity induced by each TALE protein was then analyzed 2 days after transfection. In response to multiple targets, TALE VP16 fusions can synergistically activate the reporter gene expression in mammalian cells (FIG. 3). Additionally, as shown in FIG. 4B, TALE proteins with addition of the VP16 activation domain (TR13-VP16 and TR15-VP16) activate the luciferase reporter gene. Expression of the natural TALE protein without the VP16 domain does not activate luciferase (TR13 and TR15). Thus the reporter gene activation is observed only when the correct targets are matched with their corresponding TALE fusions, suggesting that the transcriptional activation results from targeted DNA binding.

Figure 5:
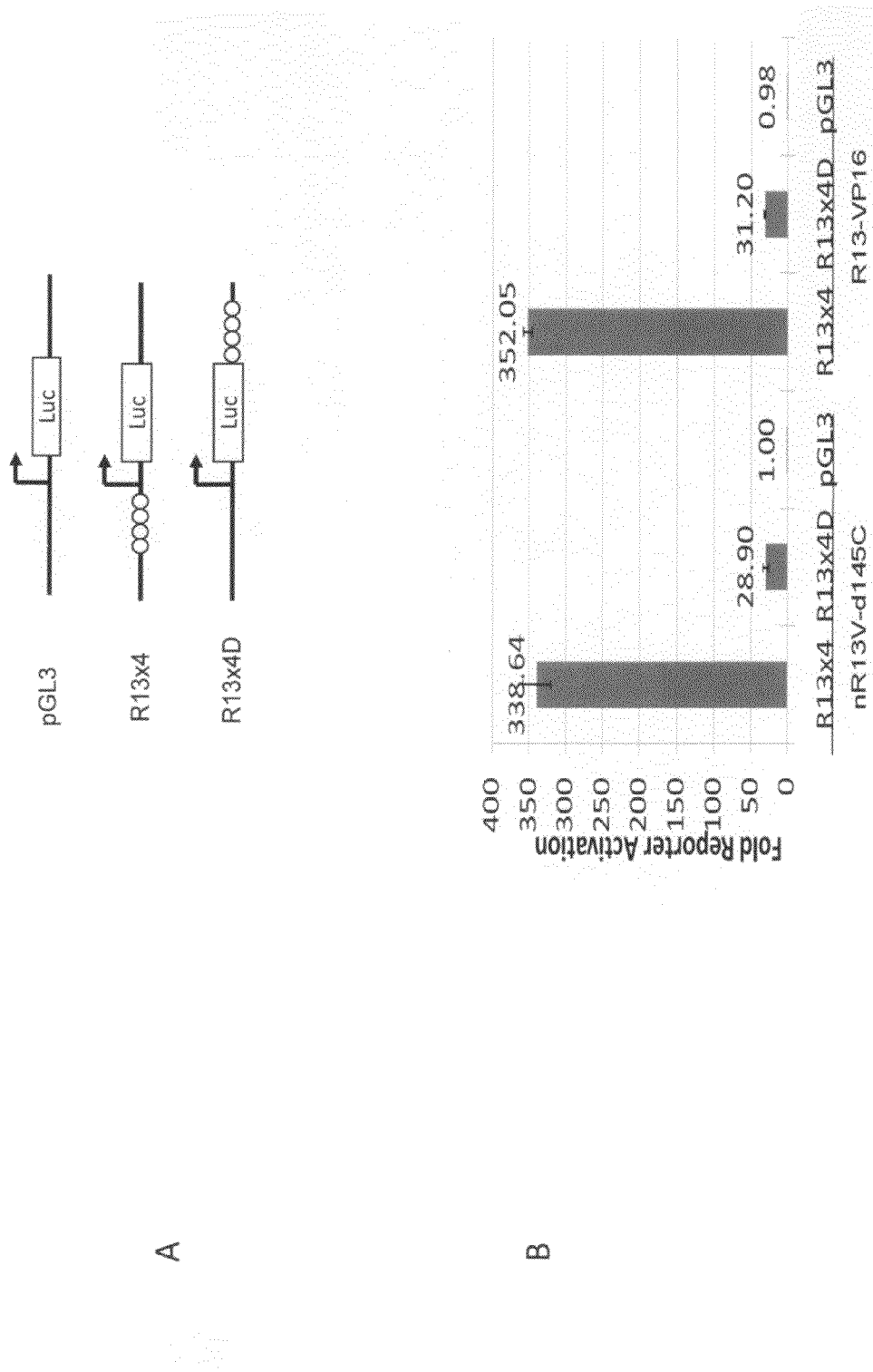
FIG. 5, panels A and B, depict positional effects of target sequence placement relative to the promoter.

Next, the TALE target sequences were inserted in both distal and proximal locations relative to the targeted promoter. In this experiment, the TALE13 target was used as shown in FIG. 5A where four target sequences were inserted either upstream (for example "R13x4") or downstream ("R13x4D") of the promoter. The results, shown in FIG. 5B TR13 VP16 were introduced to create two unique restriction sites, ApaI and HpaI, at the beginning of the first tandem repeat and the end of last tandem repeat, respectively. These ApaI and HpaI sites were then used for cloning the synthetic tandem repeats into the TR13 VP16 backbone to generate the engineered TALEs with complete N- and C-terminal sequences flanking the tandem repeats, as well as the VP16 activation domain.

The targeted sequence was GGAGCCATCTGGCCGGGT (SEQ ID NO:58) located within the NT3 promoter sequence. Previously a ZFP TF 23570 targeting to this sequence has shown to activate the endogenous NTF3 gene expression (See co-owned U.S. Provisional Patent application 61/206,770). The 17.5 tandem repeats from the TALE AvrBs3 were used as a backbone to engineer TALE18 (also termed "NT-L") such that the tandem repeats of the engineered TALE18 amino acid sequences were altered to specify the intended target nucleotide. The amino acid sequence of the DNA-binding domain from engineered TALE18 is shown below in Table 12, where the RVDs are shown boxed in bold:

TABLE 12

DNA-binding domain of engineered TALE18 (NT-L)

Engineered TALE18 17.5 repeats

| | | | | |
|---|---|---|---|---|
| full | 137 | R1.0 | LTPEQVVAIASNNGGKQALETVQRLLPVLCQAHG | (SEQ ID NO: 8) |
| full | 171 | R2.0 | LTPQQVVAIASNNGGKQALETVQRLLPVLCQAHG | (SEQ ID NO: 63) |
| full | 205 | R3.0 | LTPQQVVAIASNIGGKQALETVQRLLPVLCQAHG | (SEQ ID NO: 64) |
| full | 239 | R4.0 | LTPEQVVAIASNNGGKQALETVQRLLPVLCQAHG | (SEQ ID NO: 8) |
| full | 273 | R5.0 | LTPEQVVAIASHDGGKQALETVQALLPVLCQAHG | (SEQ ID NO: 65) |
| full | 307 | R6.0 | LTPEQVVAIASHDGGKQALETVQALLPVLCQAHG | (SEQ ID NO: 65) |
| full | 341 | R7.0 | LTPEQVVAIASNIGGKQALETVQALLPVLCQAHG | (SEQ ID NO: 554) |
| full | 375 | R8.0 | LTPEQVVAIASNGGGKQALETVQRLLPVLCQAHG | (SEQ ID NO: 555) |
| full | 409 | R9.0 | LTPEQVVAIASHDGGKQALETVQRLLPVLCQAHG | (SEQ ID NO: 7) |
| full | 443 | R10.0 | LTPQQVVAIASNGGGKQALETVQRLLPVLCQAHG | (SEQ ID NO: 66) |
| full | 477 | R11.0 | LTPEQVVAIASNNGGKQALETVQALLPVLCQAHG | (SEQ ID NO: 67) |
| full | 511 | R12.0 | LTPEQVVAIASNKGGKQALETVQRLLPVLCQAHG | (SEQ ID NO: 68) |
| full | 545 | R13.0 | LTPEQVVAIASHDGGKQALETVQRLLPVLCQAHG | (SEQ ID NO: 7) |
| full | 579 | R14.0 | LTPEQVVAIASHDGGKQALETVQRLLPVLCQAHG | (SEQ ID NO: 7) |
| full | 613 | R15.0 | LTPEQVVAIASNNGGKQALETVQRLLPVLCQAHG | (SEQ ID NO: 8) |
| full | 647 | R16.0 | LTPQQVVAIASNKGGRPALETVQRLLPVLCQAHG | (SEQ ID NO: 69) |
| full | 681 | R17.0 | LTPEQVVAIASNNGGKQALETVQRLLPVLCQAHG | (SEQ ID NO: 8) |
| half | 715 | R17.5 | LTPQQVVAIASNGGGRPALESIVAQLSRPDPALAA | (SEQ ID NO: 70) | demonstrate that optimal activation is seen when the TALE13 binding sites were placed upstream in close proximity to the promoter of interest.

Example 5

Construction of an Artificial TALE Transcription Factor

Having demonstrated that TALE proteins can be linked to a transcriptional regulatory domain to modulate reporter gene expression in mammalian cells, experiments were performed to engineer TALE transcription factors with desired targeting specificities. Silent mutations (i.e. a change in the nucleotide sequence without an alteration of amino acid sequence) of In addition to the four RVDs used in previous engineering efforts (NI, HD, NN, and NG to target A, C, G and T, respectively) we also incorporated the NK RVD in a subset of TALE repeats at positions corresponding to G nucleotides in the DNA target site as it was observed with a cognate target site guanine in two naturally occurring proteins (see Moscou et al, ibid). Consistent with earlier experimental studies (see Boch et al, ibid), we found that on average NI, HD, NG showed a strong preference for adenine, cytosine, and thymine respectively and NN showed a preference for guanine, but can also bind adenine. In contrast, the NK RVD shows a strong preference for guanine, representing a potential improvement for engineered TALE proteins that target sites including at least one guanine.

The DNA sequence coding for the 17.5 tandem repeats of the engineered TALE18 was then derived from the amino acid sequence and synthesized by 84 overlapping oligos, each about 40 nucleotides in length, as follows. First, the whole 1.8 kb DNA sequences were divided into 11 blocks, and overlapping oligos covering each block was assembled by PCR-based method; the 11 blocks was then fused together into 4 bigger blocks by overlapping PCR and finally, the 4 blocks were assembled into the full length by overlapping PCR using the outmost primer pairs. The synthesized tandem repeats was then sequence confirmed and cloned into the ApaI and HpaI sites of TR13-VP16, as described above, to generate the expression construct of engineered TALE18 (NT-L) targeting to the NT-3 promoter (R23570V).

The specificity of this engineered protein (termed NT-L) was then determined by SELEX, and the results are shown below in Table 13. As can be seen, the data demonstrate that it is possible to engineer an entirely novel TALE protein to bind to a desired sequence. The SELEX selection was also performed with NT-L in the clone #6 truncation (see above) as is also shown below in Table 13 demonstrating that, similar to TALE 9, the specificity of the NT-L is maintained within this truncation. The SELEX experiment was also performed with NT-L in the clone #7 truncation that showed that DNA binding specificity was maintained.

that when the NT-L repeats were used in the absence of the N-terminal and C-terminal capping regions, no activation above background was observed in this assay (compare nR23570S-dNC to mock).

TABLE 14

Reporter activation of NT-L fusion

| Construct | Fold Activation |
|---|---|
| nR23570S-dNC | 1.96 |
| nR23570SS-dNC | 3.77 |
| R23570V | 74.46 |
| R0-VP16 | 1.00 |
| Mock | 1.48 |

Figure 6:
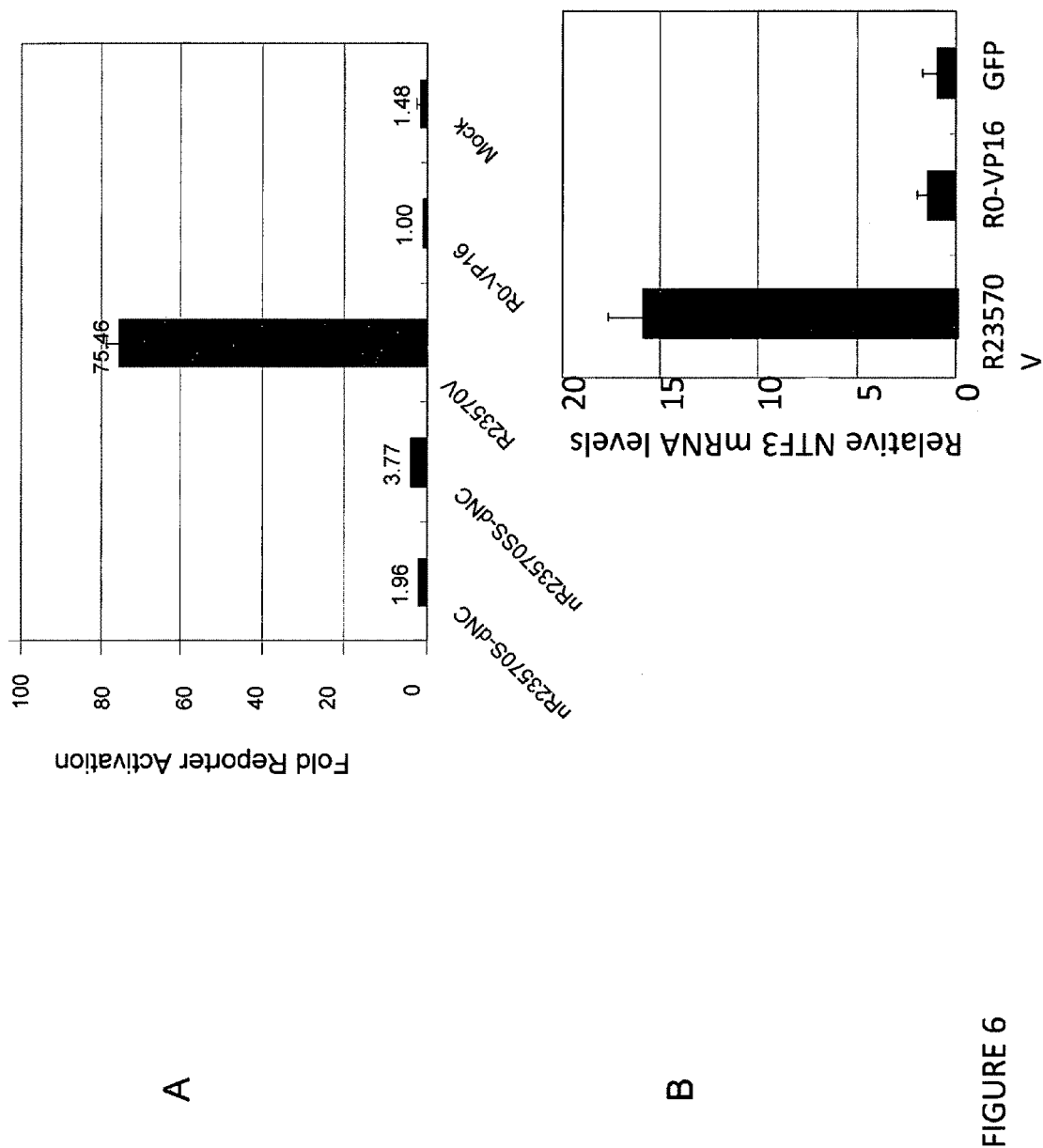
FIG. 6, panels A and B, are graphs depicting the reporter gene (luciferase) activation using a TALE fusion.

Next, the constructs were used to target the endogenous NTF3 gene to see if the engineered fusion protein was capable of activating an endogenous gene in its chromosomal locus in a mammalian cell. In the experiment of FIG. 6B, the engineered NT-L (R23570V), as well as the control constructs (R0-VP16, GFP), were transiently transfected into human 293 cells. After 2 days following transfection, the NT-3 expression level was analyzed by Taqman analysis. As shown

TABLE 13

SELEX results with NT-L, clone #2, #6, and #7

| NT-L, Clone #2, Library N22TA | | | | | | | | | | | | | | | | | | | |
|---|---|---|---|---|---|---|---|---|---|---|---|---|---|---|---|---|---|---|---|
| A | 0.00 | 0.21 | 0.10 | 0.86 | 0.48 | 0.24 | 0.00 | 0.90 | 0.00 | 0.24 | 0.17 | 0.03 | 0.21 | 0.00 | 0.07 | 0.00 | 0.03 | 0.07 | 0.03 |
| C | 0.03 | 0.00 | 0.00 | 0.10 | 0.03 | 0.76 | 0.97 | 0.07 | 0.07 | 0.59 | 0.03 | 0.00 | 0.03 | 0.97 | 0.90 | 0.07 | 0.03 | 0.07 | 0.24 |
| G | 0.00 | 0.79 | 0.90 | 0.03 | 0.28 | 0.00 | 0.00 | 0.03 | 0.00 | 0.17 | 0.03 | 0.97 | 0.76 | 0.00 | 0.00 | 0.93 | 0.83 | 0.79 | 0.07 |
| T | 0.97 | 0.00 | 0.00 | 0.00 | 0.21 | 0.00 | 0.03 | 0.00 | 0.93 | 0.00 | 0.76 | 0.00 | 0.00 | 0.03 | 0.03 | 0.00 | 0.10 | 0.07 | 0.66 |
| NT-L, Clone #6, Library N26TA | | | | | | | | | | | | | | | | | | | |
| A | 0.00 | 0.08 | 0.04 | 0.72 | 0.24 | 0.08 | 0.08 | 0.76 | 0.08 | 0.48 | 0.08 | 0.08 | 0.20 | 0.04 | 0.08 | 0.00 | 0.04 | 0.08 | 0.16 |
| C | 0.00 | 0.04 | 0.00 | 0.08 | 0.00 | 0.92 | 0.92 | 0.12 | 0.08 | 0.44 | 0.08 | 0.00 | 0.04 | 0.76 | 0.92 | 0.04 | 0.04 | 0.16 | 0.16 |
| G | 0.04 | 0.88 | 0.92 | 0.16 | 0.40 | 0.00 | 0.00 | 0.12 | 0.00 | 0.00 | 0.16 | 0.84 | 0.68 | 0.08 | 0.00 | 0.96 | 0.72 | 0.72 | 0.12 |
| T | 0.96 | 0.00 | 0.04 | 0.04 | 0.36 | 0.00 | 0.00 | 0.00 | 0.84 | 0.08 | 0.68 | 0.08 | 0.08 | 0.12 | 0.00 | 0.00 | 0.20 | 0.04 | 0.56 |
| NT-L, Clone #7, Library N22CG | | | | | | | | | | | | | | | | | | | |
| A | 0.03 | 0.10 | 0.13 | 0.92 | 0.59 | 0.18 | 0.00 | 0.95 | 0.05 | 0.64 | 0.15 | 0.00 | 0.00 | 0.00 | 0.00 | 0.00 | 0.00 | 0.00 | |
| C | 0.00 | 0.00 | 0.00 | 0.05 | 0.00 | 0.79 | 0.92 | 0.03 | 0.10 | 0.36 | 0.00 | 0.00 | 0.00 | 1.00 | 1.00 | 0.00 | 0.00 | 0.10 | |
| G | 0.00 | 0.90 | 0.87 | 0.03 | 0.28 | 0.03 | 0.03 | 0.03 | 0.00 | 0.00 | 0.08 | 1.00 | 1.00 | 0.00 | 0.00 | 1.00 | 1.00 | 0.90 | |
| T | 0.97 | 0.00 | 0.00 | 0.00 | 0.13 | 0.00 | 0.05 | 0.00 | 0.85 | 0.00 | 0.77 | 0.00 | 0.00 | 0.00 | 0.00 | 0.00 | 0.00 | 0.00 | |

The transcriptional activity of the engineered NT-L proteins was then analyzed against a luciferase reporter construct containing two copies of the target sequence. As shown below in Table 14 and FIG. 6A, the engineered NT-L fusion protein (R23570V), containing the engineered 17.5 tandem repeats but otherwise identical to TR13-VP16, is capable of driving potent reporter gene activation, whereas the similar construct with no tandem repeats (R0-VP16) does not activate luciferase. The TALE sequences flanking the full length tandem repeats (N-cap and C-cap) are required for the reporter gene activation as the deletion of either the N-terminal or C-terminal sequence flanking the repeats (nR23570S-dNC and nR23570S-dNC, respectively) abolished the transcriptional activity. The construct termed nR23570S-dNC contained the SV40 nuclear localization signal (n) and the engineered NT-L repeats (R23570) fused to a single p65 activation domain (S). This construct contained only the repeats but no N-terminal or C-terminal sequence from TALE (dNC). The constructed nR23570SS-dNC was same as described for nR23570S-dNC except that it had two p65 activation domains.

As can be seen from Table 14, the highest level of activation of the reporter was found with the R23570V construct. Note in FIG. 6B, expression of engineered NT-L (R23570V) lead to a substantial increase in NTF3 mRNA expression in human 293 cells, whereas expression of control proteins (R0-VP16 or GFP) had no effect on NTF3 expression level. This is the first time that a specifically engineered TALE domain fusion protein has been used in a mammalian cell to activate expression of an endogenous gene.

Figure 7:
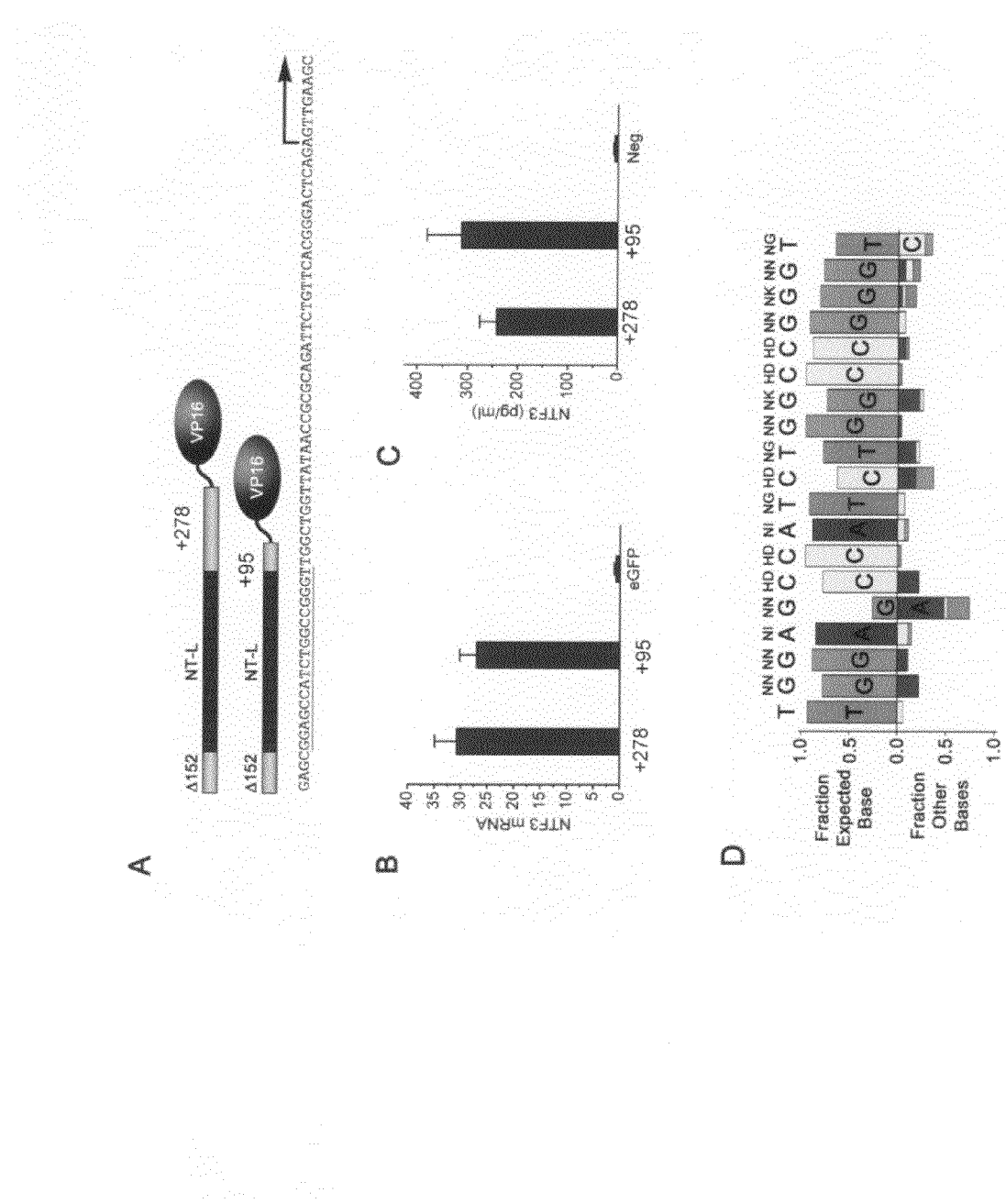
FIG. 7, panels A to D, depict additional exemplary NTF3-specific TALE transcription factor fusions.

An additional exemplary construct was made to determine if all 278 residues of the C-terminal regions flanking the TALE repeat domain was required for activity. This additional construct (+95) contained only the first 95 residues of the C-terminal region between the TALE repeat domain and the VP16 activation domain (i.e. C+95 C-cap). FIG. 7 shows a diagram of these two constructs (the +278 construct was referred to as R23570V in FIG. 6) and the effect of these proteins on NTF3 activation at the mRNA and protein levels. Also shown are the SELEX results for the longer of these constructs (containing the +278 C-terminal (or full length) domain). As can be seen in the figure, both TALE transcription factor constructs are able to up-regulate NTF3 expression at both mRNA and protein levels.

Constructs specific for binding in regions in the VEGF, CCR5 and PEDF gene were also generated. As described above, repeat domains were engineered to bind to these targets by the methodology described above. Target sites for these proteins are shown below in Example 7. The proteins contained either 10-repeat or 18-repeat DNA binding domains.

Figure 8:
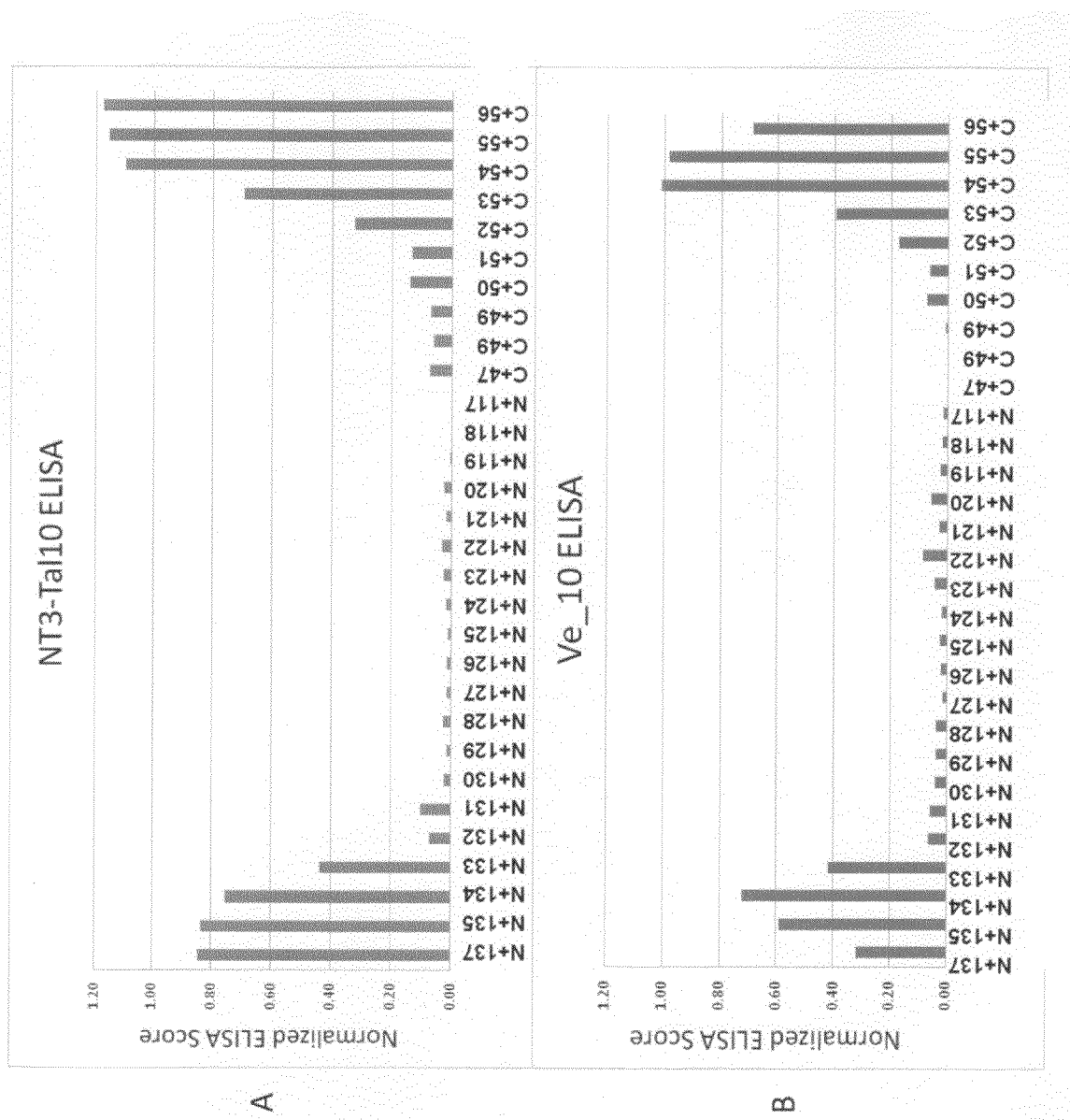
FIG. 8, panels A and B, are graphs depicting the DNA binding ability, as assayed by ELISA, of a series of N- and C-terminal truncations of various engineered TALE DNA binding domains.
Figure 9:
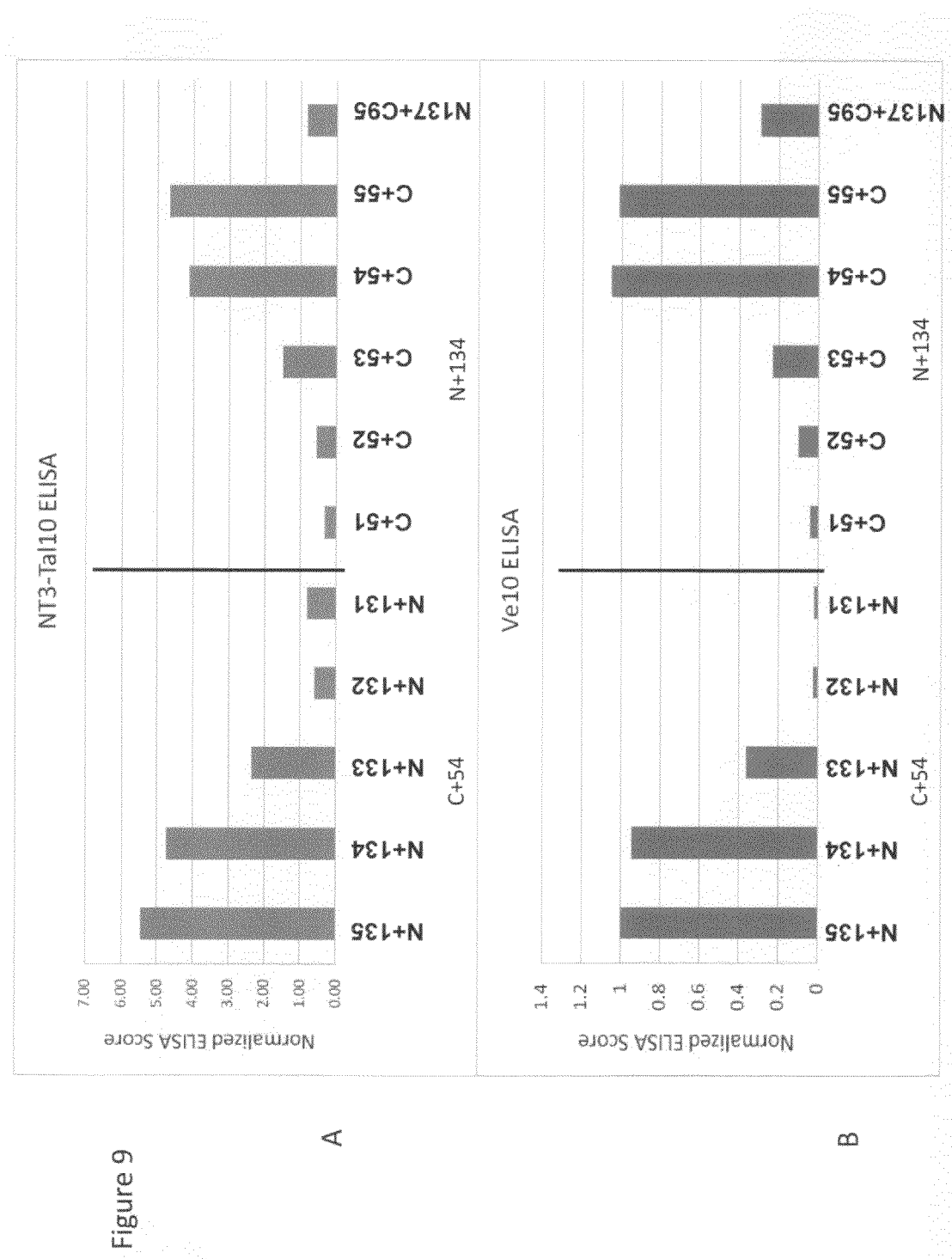
FIG. 9, panels A and B, depict the DNA binding activity, as assayed by ELISA, of a series of N- and C-terminal truncations as described above.

Additionally, a series of truncations were made in the 9.5 repeat NTF3-specific and the 9.5 repeat VEGF-specific TALE DNA binding domains. The truncations were expressed in the TNT Coupled Reticulocyte Lysate system (Promega) and the lysate was used to bind to the DNA fragments as follows. The protein were expressed by adding 5 µL of water containing 250 nanograms of the nuclease fusion clone plasmid to 20 µL of lysate and incubating at 30° C. for 90 minutes. The binding assays were done as described above. Western blots using standard methodology confirmed that the expressed proteins were all equally expressed. The results of the binding assays are shown in FIG. 8. In these experiments, for truncations of the N-terminus, the C-terminal amino acid was held at C+95, while for the C-terminal truncations, the N-terminus was maintained with the N+137 configuration. As can be seen from the Figure, in this assay, maximal binding was observed when the proteins contained at least 134 amino acids on the N-terminal side of the first true repeat, and at least 54 amino acids on the C-terminal side of the half repeat, and interestingly, this was true for both the TALE DNA binding domain targeted to the NTF3 sequence and for the one targeted to the VEGF sequence (compare panels A and B). The truncations around the critical 134 N-terminal position were repeated using a protein where the C-terminus was truncated to +54 (rather than C+95 as described above) and the C-terminal truncations were repeated where the N-terminus was truncated to the +134 position (rather than N+137). The data are presented in FIG. 9 and show a similar drop-off in DNA binding when the C terminus was truncated past +54 and/or when the N terminus was truncated past +134 as was observed in the previous experiment. These data indicate that the minimal caps for optimal binding in this in vitro affinity assay extend to positions N+134 and C+54.

Example 6

Dissection of the TALE Functional Domains Involved in DNA Targeting in Mammalian Cells In this example, various deletions at N-terminal or C-terminal of TALE13 proteins, as indicated below in Table 15, were generated.

TABLE 15

TALE 13 deletion constructs

| Construct Name | N-cap   | C-cap   |
|----------------|---------|---------|
| R13            | N + 137 | C + 278 |
| R13-dN         | N + 8   | C + 278 |
| R13-d240N      | N + 34  | C + 278 |
| R13-d223N      | N + 52  | C + 278 |
| R13-d145C      | N + 137 | C + 133 |
| R13-d182C      | N + 137 | C + 95  |
| R13-dC         | N + 137 | C + 22  |

Figure 10:
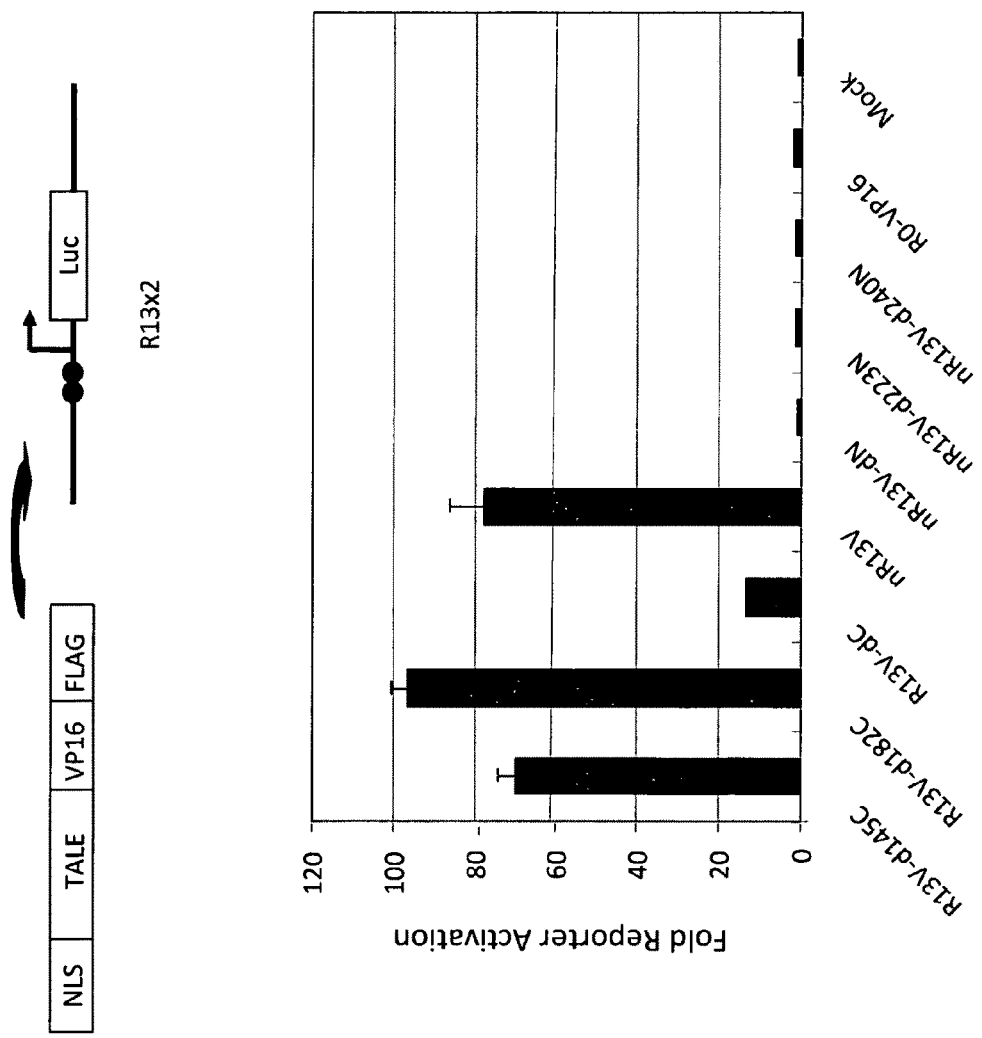
FIG. 10 shows dissection of TALE functional domains involved for activity. The activities for reporter gene activation by indicated constructs as illustrated in Table 16 were investigated. The results indicate that (i) the N-terminal 152 amino acids and C-terminal 183 amino acids are not required for robust function in this assay; and (ii) the sequence flanking the tandem TALE repeats, including R0 region and the leucine rich domain, restore the functional activity in cells in this assay. Deletion of either N-terminal sequence preceding the first TALE repeat or C-terminal sequences following the last repeat abolishes functional activity in this assay. R13V-d145C has a C+133 C-cap, R13V-d182C has a C+95 C-cap, R13V-dC has a C+22 C-cap, nR13V-dN has a N+8 N-cap, nR13V-d223N has an N+52 N-cap and nR13V-d240 has an N+34 N-cap.

All constructs were linked to the VP16 activation domain (constructs with VP 16 were designated "R13V") and a nuclear localization signal (constructs with NLS were designated "nR13"), and tested for reporter gene activation from a reporter construct containing 2 copies of predicted TALE13 targets (FIG. 10, top panel).

As shown in FIG. 10, the minimal region that retains robust reporter activation activity in this set of constructs (see Table 15) is R13V-d182C, which lacks 152 amino acids at its N-terminus and 183 amino acids at its C-terminus. The result confirms that R0 region preceding the first tandem repeats and the leucine rich region following the last repeat is provides optimal binding in this assay, whereas the region containing nuclear localization signal, and the native activation domain at its C-terminus is dispensable for DNA-targeting in mammalian cells.

Example 7

Demonstration of Nuclease Cleavage Activity of a TALE Linked to Nuclease Domains Next, the DNA targeting ability of TALEs in the context of artificial TALE nucleases (TALENs) was evaluated. The DNA targeting domain of TALE13 as defined in Example 6 was linked to nuclease domains to generate a construct named as R13d182C-scFokI, which is the same as R13V-d182C described above, except that two copies of the FokI nuclease domain, linked by 12 copies of GGGS sequence (SEQ ID NO: 127) between the FokI domains, were used to replace the VP16 activation domain. The TALEN construct was then tested for nuclease activity in a single stranded annealing (SSA) based reporter assay (see co-owned US Patent Publication No. 20110014616).

Figure 11:
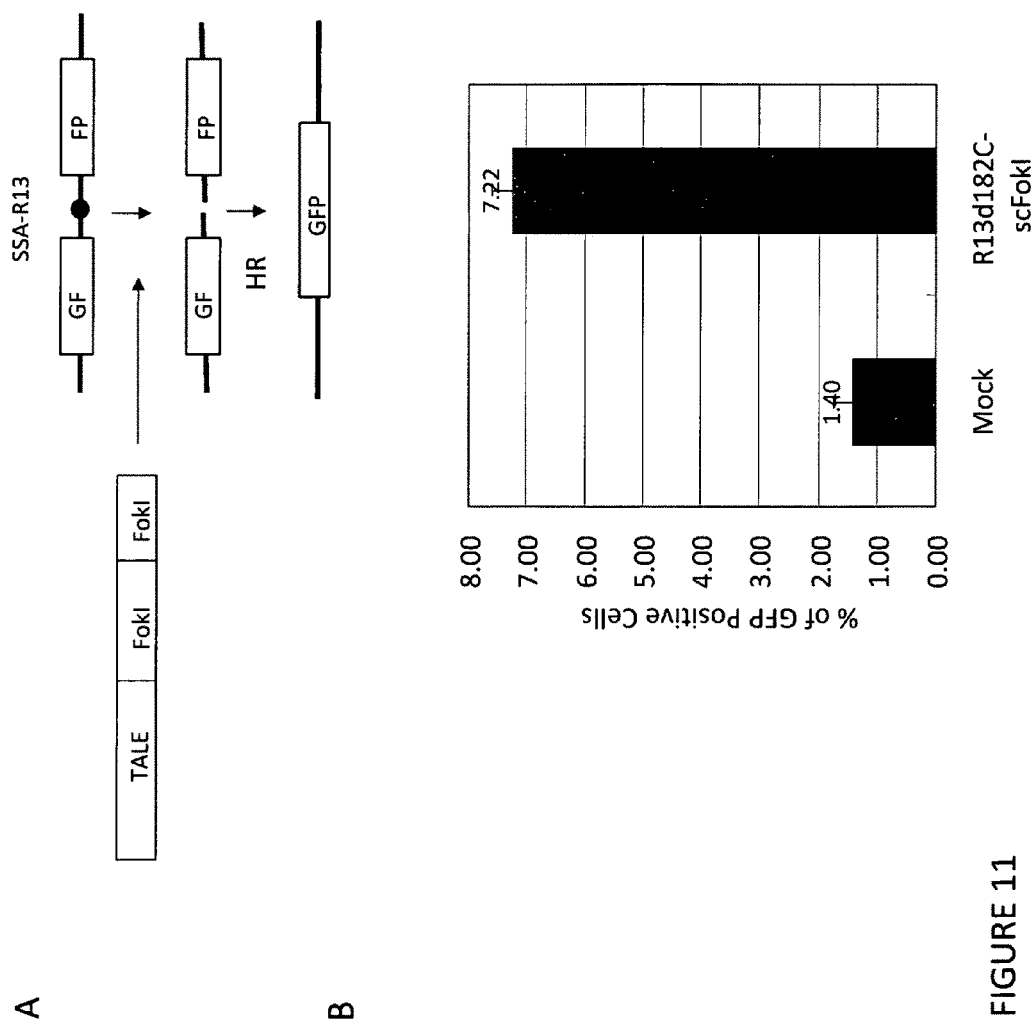
FIG. 11, panels A and B, depict nuclease activity of TALE13 linked to two copies of the FokI domain in K562 cells.

The reporter construct (FIG. 11A, SSA-R13) used in this assay contains the predicted TALE 13 target, sandwiched by the N-terminal (GF) and C-terminal part (FP) of the GFP coding sequence. The reporter SSA-R13 by itself cannot drive the GFP expression, but the cleavage at the TALE13 target will promote homologous recombination (HR) among the N- and C-terminal part of GFP to form a functional GFP transgene. In the experiment whose results are depicted in FIG. 11B, the SSA-R13 reporter construct, together with or without (mock) the TALEN construct, was transiently nucleofected into K562 cells as described previously.

Two days following nucleofection, the percentage of GFP positive cells was analyzed by flow cytometry. As shown in FIG. 11B, about 7% GFP positive cells were generated from SSA-R13 reporter plasmid by the TALEN fusions (R13d182C-scFokI), compared to about 1.4% in the control experiment lacking the TALE plasmid (mock), representing a significant increase in the cleavage at TALE13 target in the SSA-R13 reporter.

These data demonstrate that TALE DNA binding domains can be used to generate functional TALENs for site specific cleavage of DNA in mammalian cells.

TALE domain fusions were also constructed using FokI cleavage half domains. For these examples, wild type FokI half cleavage domains were used so that for nuclease activity, a homodimer must be formed from two of the fusions. For these fusions, the TALE13 DNA binding domain was fused to each FokI half domain by cloning the TALE DNA binding domain into a plasmid adjacent to FokI-specifying sequence. In addition, various linkers were tested for use between the DNA binding domain and the nuclease domain. Linkers L2 and L8 were used which are as follows: L2=GS (SEQ ID NO:71) and L8=GGSGGSGS (SEQ ID NO:72). The target sites were cloned into a TOPO2.1 target vector (Invitrogen) with varying gap spacings between each target binding site such that the two were separated from each other by 2 to 22 bp. PCR amplification of an approximately 1 kb region of the target vector was done to generate the target DNAs. The TALE DNA binding domains were also truncated as described previously, and are described using the same nomenclature as described above in Examples 2 and 6. The TALE domain nuclease fusion clones were expressed in the TNT Rabbit Reticulocyte Lysate system by adding 5 µL of water containing 250 nanograms of the nuclease fusion clone plasmid to 20 µL of lysate and incubating at 30° C. for 90 minutes.

The lysate was then used to cleave the target DNAs as follows: 2.5 µL of lysate were added to a 50 µL reaction containing 50 nanograms of PCR-amplified target DNA and a final Buffer 2 (New England Biolabs) concentration of 1×. The cleavage reaction was for one hour at 37° C., followed by a 20 minute heat inactivation stage at 65° C. The reaction was then centrifuged at high speed to separate the target DNA from the lysate, causing the lysate to condense into a pellet in the reaction well. The DNA-containing supernatant was pipetted off and run on an ethidium bromide-stained agarose gel (Invitrogen) to separate intact target DNA from cleaved target DNA. The agarose gel was then analyzed using AlphaEaseFC (Alpha Innotech) software to measure the amount of target DNA present in the large uncleaved DNA band and the two smaller DNA bands resulting from a single cleavage event of the target DNA. The percentage of cleaved DNA out of the total amount of target DNA loaded into the gel represents the percent cleavage in each reaction.

We desired to minimize the flanking regions of the TALE proteins in an effort to pare the fusions down to the specific regions required for efficient binding, reasoning that trimming the extraneous peptide sequence would provide a more constrained attachment of the FokI cleavage domain, which could improve the catalytic activity of the TALENs. The truncations made on the N- and C-terminal ends (SEQ ID NO:73 and SEQ ID NO:369) of the TALE DNA binding domain were made as shown below where the truncation sites are indicated above the amino acid sequence, and the predicted secondary structure (C=random coil, H=helix) is indicated underneath the sequence:

```
C-Cap:
                                         C+28        C+39        C+50       C+58
LTPEQVVAIASNGGGRPALESIVAQLSRPDPALAALTNDHLVALACLGGRPALDAVKKGLPHAPALIKRTNRRIPERTSHRV
CCHHHEEEEECCCCCHHHHHHHHHCCCCCCHHHHHCCHHHHHHHHHHCCCCHHHHHHHCCCCCCHHHHHHHCCCCCCCCCCC
C+63              C+79          C+95
ADHAQVVRVLGFFQCHSHPAQAFDDAMTQFGMSRHGL
CCCHHHHHHHHHHHCCCCHHHHHHHHHHHHHCCCHHHH

N-Cap:
N+137   N+130      N+119           N+104
MVDLRTLGYSQQQQEKIKPKVRSTVAQHHEALVGHGFTHAHIVALSQHPAALGTVAVKYQDMIAALPEATHEAIVGV
   N+134
CCCHHHCCCCHHHHHHHCHHHHHHHHHHHHHHHHCCCCCHHHHHEECCCHHHHHHHHHCCHHHHHHHCCHHHHHHHHHH
```

Figure 12:
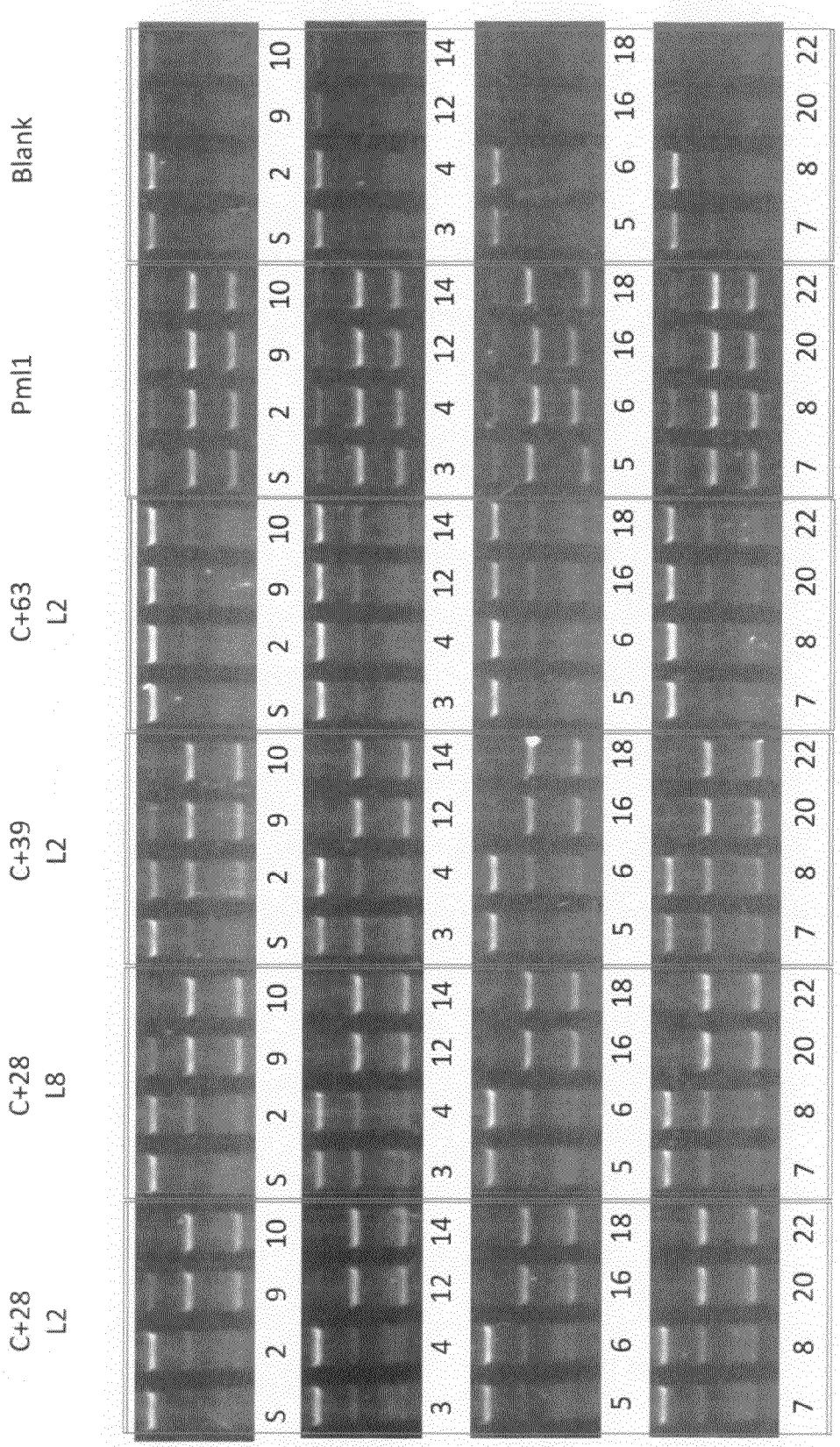
FIG. 12 depicts an ethidium bromide gel showing nuclease activity of the TALE-13 effector domain-FokI cleavage half-domain fusions in vitro. The columns show data for four TALE domain nuclease cleavage proteins: the nuclease fusion with a N+137, C+28 configuration using either the L2 or L8 linker (see Example 7); the nuclease fusion with the N+137, C+39 configuration, using the L2 linker; and the N+137, C+63 fusion with the L2 linker. The gap spacings between the two target sites are shown beneath the wells where the number indicates the number of by between the targets. "S" indicates a single target site for only one half of the pair. "PmlI" indicates cleavage with a standard restriction enzyme and blank indicates the results when the experiment was carried out without the nuclease encoding plasmid.
Figure 13:
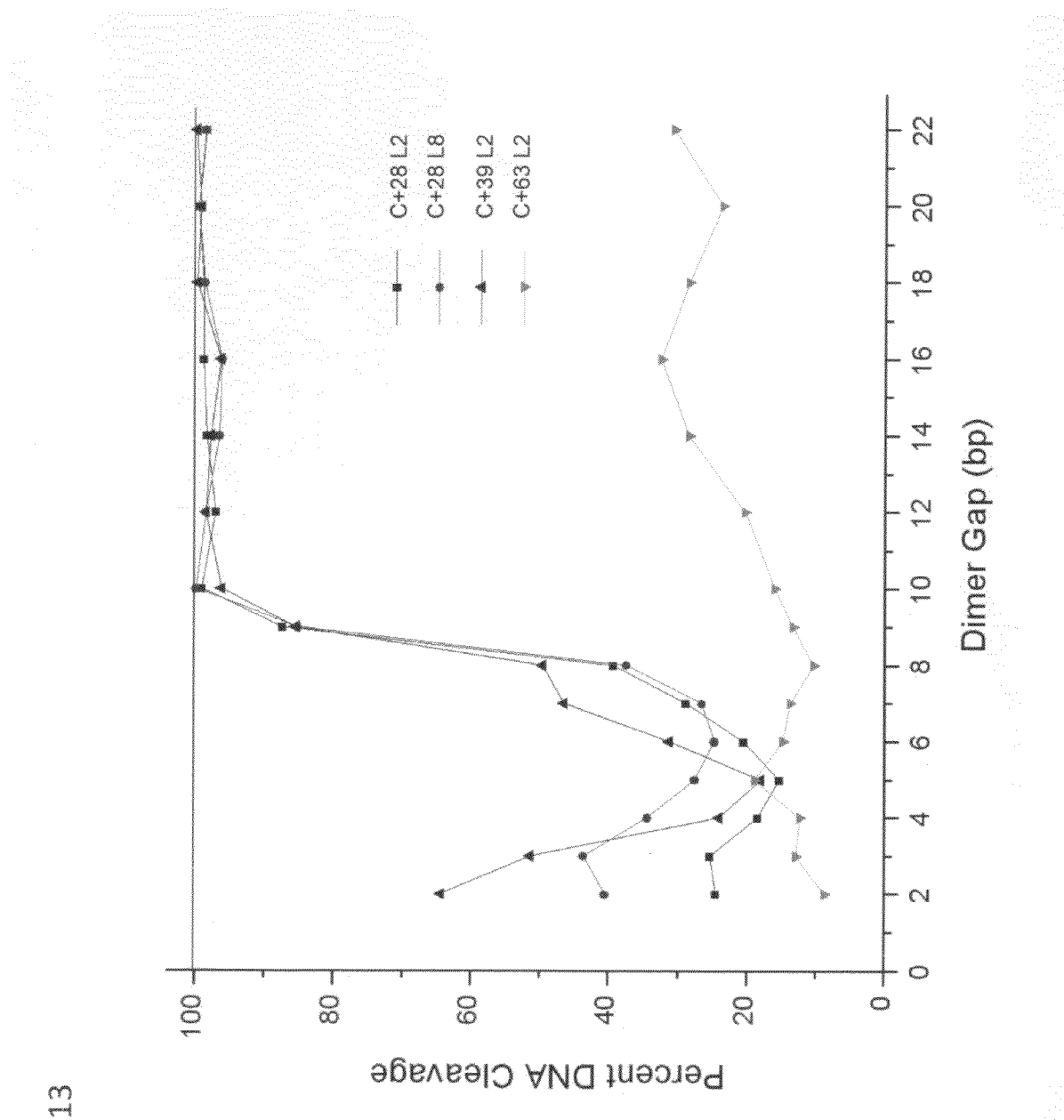
FIG. 13 is a graph depicting the DNA cleavage obtained by the indicated TALE13-FokI cleavage half domain fusions. "Dimer Gap" indicates the number of by between the two target sites, and "Percent DNA Cleavage" indicates how much DNA was cleaved in the reaction. The results indicate that virtually 100 percent DNA cleavage is achievable in these reaction conditions with the three of the four nucleases tested.

The results of the C-terminal deletion studies are shown in FIGS. 12 and 13. FIG. 12 shows the cleavage of the target sequences by visualizing the cleavage products on ethidium bromide stained agarose gels. In FIG. 12, L2 or L8 indicates the linker used, and the number beneath each lane indicated the by gap between the two target DNA binding sites of the dimer. 'S' indicates the presence of only one target DNA binding site such that an active nuclease homodimer cannot form on the DNA. "Pml1" indicates the positive control reaction of cleavage using a commercially-available restriction enzyme (New England Biolabs) of a unique restriction site located in the cloned DNA target sequence next to the TALE binding sites. Cleavage at the PmlI site indicates that the cloned target site exists in the PCR-amplified target DNA and also shows the approximate expected size of cleaved DNA. Blank indicates the negative control TNT reaction without the TALEN encoding plasmid such that no TALEN was produced. The data is depicted in a graphical format in FIG. 13, and shows that the cleavage activity of the protein greatly increases with C+28 and C+39 C-caps for a spacer length of at least 9 bases. These experiments were continued and further C-caps (C−2, C+5, C+11, C+17, C+22, C+25, C+28 and C+63) were constructed. The results are summarized below in Table 16. "Spacer" indicates the number of base pairs between the target sites and "SC" indicates those samples containing only one binding site in the target.

TABLE 16

| C terminal truncations of TALE13-homodimer pairings in vitro | | | | | | | | |
|---|---|---|---|---|---|---|---|---|
| spacer | C−2 | C+5 | C+11 | C+17 | C+22 | C+25 | C+28 | C+63 |
| SC | 0.0% | 0.0% | 0.0% | 11.4% | 19.5% | 7.7% | 8.0% | 10.4% |
| 4 | 12.9% | 11.9% | 17.4% | 27.9% | 51.8% | 21.1% | 19.4% | 26.6% |
| 8 | 10.2% | 23.4% | 27.4% | 33.6% | 46.2% | 26.1% | 35.4% | 15.2% |
| 10 | 16.9% | 97.7% | 98.9% | 98.6% | 99.9% | 93.4% | 94.8% | 12.8% |

TABLE 16-continued

C terminal truncations of TALE13-homodimer pairings in vitro

| spacer | C-2 | C+5 | C+11 | C+17 | C+22 | C+25 | C+28 | C+63 |
|---|---|---|---|---|---|---|---|---|
| 12 | 1.1% | 99.3% | 98.5% | 97.8% | 98.1% | 96.5% | 96.5% | 27.1% |
| 14 | 5.1% | 98.7% | 96.9% | 99.0% | 98.5% | 98.5% | 96.2% | 32.6% |
| 16 | 1.4% | 98.3% | 98.9% | 99.9% | 97.6% | 97.5% | 96.1% | 37.1% |
| 20 | 4.9% | 99.2% | 98.9% | 99.9% | 98.8% | 99.3% | 98.3% | 28.9% |

As can be seen from the data presented above, it appears that the proteins become less active in this assay as fusion nucleases when the C-terminus is truncated past approximately C+5.

Cleavage activity of TALE13 nucleases with additional C-terminal truncation points when presented with a target with the indicated spacer was also assessed and results are shown in Table 17 below. "S" indicates that the cleavage target contained a single binding site for TALE13.

TABLE 17

TALE 13 nuclease C-terminal truncations

| | C-terminal truncation point | | | | | |
|---|---|---|---|---|---|---|
| Spacer (bp) | C+28 | C+39 | C+50 | C+63 | C+79 | C+95 |
| 2 | <5 | <5 | <5 | <5 | <5 | <5 |
| 4 | <5 | <5 | <5 | <5 | <5 | <5 |
| 6 | <5 | <5 | <5 | <5 | <5 | <5 |
| 8 | <5 | <5 | <5 | <5 | <5 | <5 |
| 10 | 96 | 45 | <5 | <5 | <5 | <5 |
| 12 | 100 | 99 | 62 | 33 | 26 | <5 |
| 14 | 100 | 100 | 82 | 70 | 52 | <5 |
| 16 | 100 | 100 | 83 | 70 | 56 | <5 |
| 18 | 99 | 100 | 81 | 75 | 59 | <5 |
| 20 | 89 | 99 | 93 | 75 | 65 | <5 |
| 22 | 99 | 99 | 94 | 79 | 69 | <5 |
| 24 | 100 | 100 | 92 | 83 | 60 | <5 |
| S | >5 | <5 | <5 | <5 | <5 | <5 |

Figure 14:
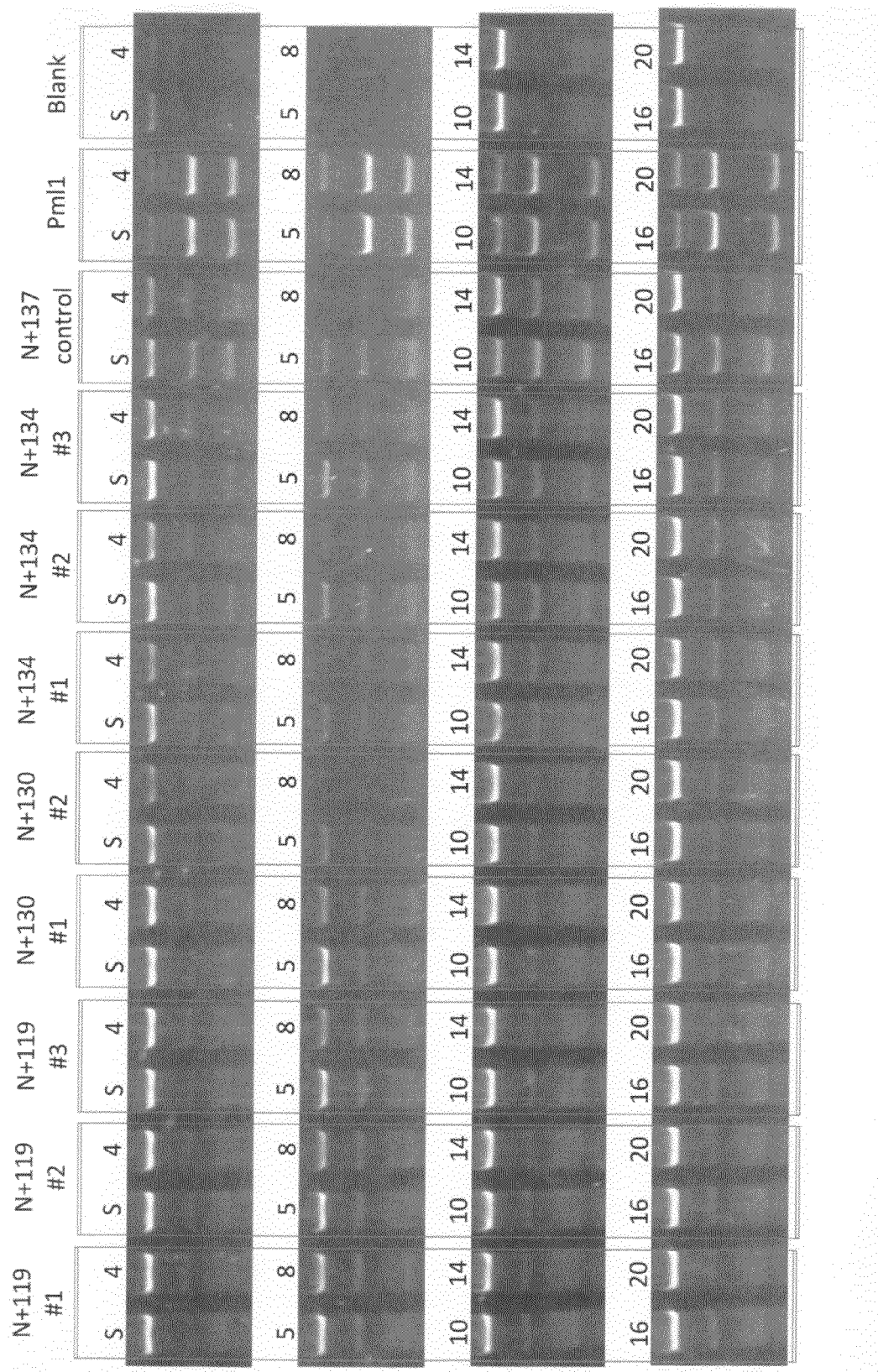
FIG. 14 depicts an ethidium bromide-stained gel showing nuclease activity of the TALE domain-FokI half cleavage domain fusions. In this experiment, the N-terminus was varied while the C-terminus was maintained with the C+63 configuration. The Pml1 and Blank controls are the same as for FIG. 12. The N-terminal truncations tested in this experiment were N+137, N+134, N+130 and N+119. The different DNA target sites are indicated as in FIG. 12 except that the label is above the cognate lane rather than below it. Activity of the nucleases is diminished when the N-terminus is shorter than approximately +134 to +137. The amount of DNA loaded in each lane for the 5 bp gap and 8 bp gap targets was uneven so it is difficult to determine if the lower bands in these lanes represent DNA cleavage products or background bands due to inefficient PCR at the inverted repeats.

Similar to the work done on the C-terminal region of the TALE proteins, deletions were made in the N-terminus as well. The data is presented in FIG. 14 and it is apparent that the activity of the protein with the N-terminal deletions is diminished when truncations are introduced relatively close to the N+137 position. In this Figure, each column is labeled with the corresponding N-terminal truncation and the number of the separate clones that were used. "S" indicates that only a single binding site was present in the target. The sum of these results indicates that the TALENs can be quite active when linked to either FokI half domains or to two half domains which can interact in a single chain configuration, but the length of the N-cap and C-cap has an effect on the DNA cleavage properties of the resulting TALENs.

TALENs were constructed to bind to an endogenous target in a mammalian cell. The 10 repeat NTF3 binding domain was linked to a FokI half domain as described above. In addition, a NTF3 specific partner (rNTF3) was constructed commercially using standard overlapping oligonucleotide construction technology. The synthetic NTF3 partner was made with three variants at the C terminus: C+63, C+39 and C+28, and the TALE DNA binding domain was cloned into a standard ZFN vector which appends an epitope tag and a nuclear localization signal to the C-terminus and the wild-type FokI cleavage domain to the C-terminus. The complete amino acid sequences of the constructs used in these experiments are shown in Example 23.

In addition to the 9.5 repeat NTF3-FokI fusion, and the 18 repeat NTF3-specific NT-L protein, TALENs were also made to target a site specific for the VEGF A gene. This fusion protein contained 9.5 repeat units and was constructed as described above. The 18 repeat NT-L and the VEGF-specific TALENs were also made with either a C terminal truncation of either +28, +39 or +63. These synthetic fusion nucleases were then used in vitro in nuclease assays as above, in various combinations. The substrate sequences are shown below with the capital letters indicating the target binding sites for the various fusions:

```
NTF3-NTF3 substrate (SEQ ID NOS: 77 and 128, respectively in order
of appearance):
              NT3-18/NT3-10
 gcacgtggcGGAGCCATCTGGCCGGGTtggctggttataaccgcgcagattctgttcaccgcgcgata
 acgtgcaccgcctcggtagaccggcccaaccgaccaatatTGGCGCGTCTAAGACAAGtggcgcgcta
                                                            rNT3

NT3-VEGF substrate (SEQ ID NOS: 78 and 129, respectively in order
of appearance):
              NT3-18/NT3-10
 gcacgtggcGGAGCCATCTGGCCGGGTtggctggttatgaaggggaggatcgatcggacgcgcgata
 acgtgcaccgcctcggtagaccggcccaaccgaccaatacTTCCCCCTCCtagctagcctgcgcgcta
                                                            VEGF-10

VEGF-NT3 substrate (SEQ ID NOS: 79 and 130, respectively in order
of appearance):
              VEGF-10
 gcacgtggccatggactCCTCCCCCTTcagctggttataaccgcgcagattctgttcaccgcgcgata
 acgtgcaccggtacctgaggaggggggaagtcgaccaatatTGGCGCGTCTAAGACAAGtggcgcgcta
                                                            NT3-18/NT3-10
```

The results from these studies are presented below in Tables 18 and Table 19.

TABLE 18

TALEN pairs specific to human NTF3

| Samples | | Left NT3 | Right rNTF3 | In vitro cleavage (av) |
|---|---|---|---|---|
| 1 | 16 | R10 C28L2 | C28L2 | 20% |
| 2 | 17 | R10 C28L2 | C39L2 | 26% |
| 3 | 18 | R10 C28L2 | C63L2 | 42% |
| 4 | 19 | R10 C39L2 | C28L2 | 51% |
| 5 | 20 | R10 C39L2 | C39L2 | 43% |
| 6 | 21 | R10 C39L2 | C63L2 | 60% |
| 7 | 22 | R10 C63L2 | C28L2 | 66% |
| 8 | 23 | R10 C63L2 | C39L2 | 57% |
| 9 | 24 | R10 C63L2 | C63L2 | 36% |
| 10 | 25 | R18 C28L8 | C28L2 | 16% |
| 11 | 26 | R18 C28L8 | C39L2 | 15% |
| 12 | 27 | R18 C28L8 | C63L2 | 11% |
| 13 | 28 | R18 C63L2 | C28L2 | 6% |
| 14 | 29 | R18 C63L2 | C39L2 | 4% |
| 15 | 30 | R18 C63L2 | C63L2 | 2% |

Note that Table 18 shows duplicate testing of each TALEN pair. For example, samples 1 and 16 are the same combination of TALEN monomers.

TABLE 19

TALENs targeted to combinations of either NTF3/NTF3 or NTF3/VEGF

| | | Pairs | | | | 1 protein control | |
|---|---|---|---|---|---|---|---|
| | | NT-L | | | | | NN site |
| | | NT3 R10, C+28 L2 #1 | NT3 R10, C+28 L2 #2 | NT3 R10, C+63 | VEGFR10, C+28 L2 | rNT3 C48 L2 #1 | 4.7% |
| | | | | | | rNT3 C28 L2 #2 | 4.3% |
| NT-R | rNT3 C28 L2 #1 | 38.4% | 46.4% | 72.7% | 41.8% | rNT3 C39 L2 #1 | 3.1% |
| | rNT3 C28 L2 #2 | 27.4% | 27.9% | 69.7% | 27.6% | rNT3 C39 L2 #2 | 2.3% |
| | rNT3 C39 L2 #1 | 41.1% | 42.1% | 62.0% | 37.8% | rNT3 C+63 L2 | 2.5% |
| | rNT3 C39 L2 #2 | 32.3% | 33.3% | 62.4% | 32.5% | NT3 R10 C28 L2 #1 | 3.5% |
| | rNT3 C63R #1 | 12.6% | 10.7% | 4.4% | 3.4% | NT3 R10 C28 L2 #2 | 14.6% |
| | rNT3 C63 #2 | 63.3% | 59.6% | 38.4% | 61.8% | NT3 R10 C63 | 4.1% |
| | VegF R10 C28 L2 | 90.0% | 95.0% | 90.8% | | | |
| | VegF R10 C63 | 94.1% | 96.5% | 72.7% | | | |

NN refers to the relevant portion of the endogenous NTF3 target with a binding for both the left (NT-L) and the right (NT-R) NTF3 TALENs.
1 or #2 refers to different clones of the same construct.

Thus, these proteins are active as nucleases in vitro.

Figure 15:
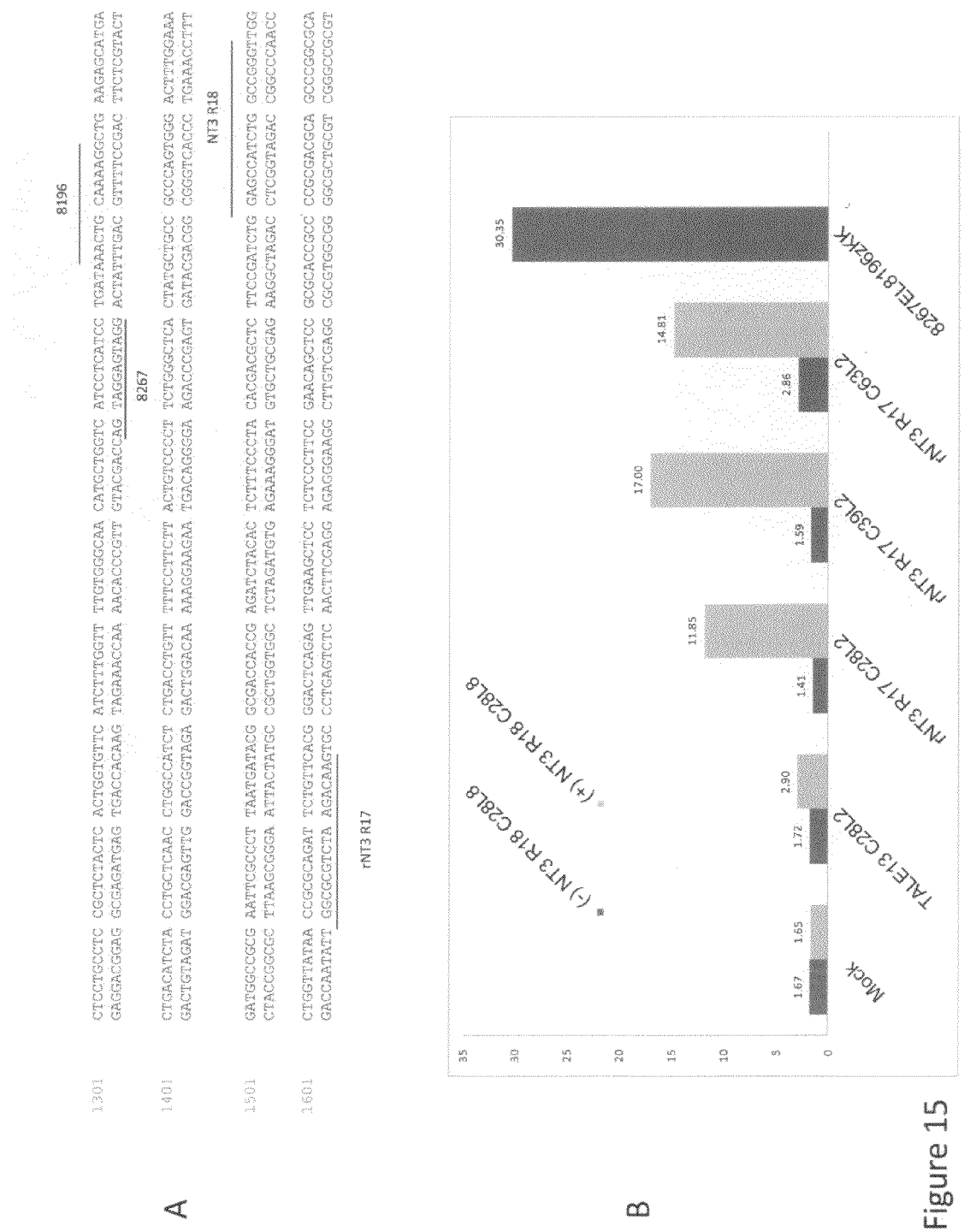
FIG. 15, panels A and B, depict TALEN activity in K562 cells.

These proteins were also used in an assay of endonuclease activity in a mammalian cell using the SSA reporter system described above. A target substrate (shown in FIG. 15A, SEQ ID NOS 342 and 452, respectively, in order of appearance) was cloned in between the disjointed GFP reporter such that cleavage at the NTF3 site followed by resection will result in a whole GFP reporter capable of expression. This substrate contains both a NTF3 target sequence and a target sequence specific for targeting the CCR5 gene. FIG. 15B depicts the results of this experiment using a selection of the NTF3-specific TALE proteins. In this experiment the following NTF3-specific TALEN fusions were used. TALE13C28L2 is the TALE13 derivative described above with a C+28 truncation and the L2 linker. rNT3R17C28L2 is the 17.5 repeat NT3-specific protein (that targets the reverse strand of the DNA with respect to the coding strand of the NT3 gene) with the C+28 truncation and L2 linker. rNT3R17C39L2 is the similar construct with the C+39 C terminus, and rNT3R17C63L2 has the C+63 C terminus. This rNT3R17 DNA binding domain is also termed NT-R. The 8267EL/ 8196zKK is a control using a pair of CCR5 specific zinc finger nucleases. The data labeled as "−NT3 R18 C28L8" depicts the results in the absence of the NTF3 specific partner (that targets the forward strand of DNA with respect to the coding strand of the NTF3 gene), while the data labeled as "+NT3 R18 C28L8" depicts the results in the presence of the partner. In this case, the partner is an NTF3 specific protein with 17.5 repeats, truncated at the C28 position and containing the L8 linker. As can be seen in the Figure, the correct pairing of the TALENs leads to efficient cleavage of the reporter gene and thus reporter gene expression.

Example 8

Use of Engineered TALENs to Cleave an Endogenous Locus in a Mammalian Cell

The dimer pairs described above that were targeted to the NTF3 locus (see Table 18) were then tested at the endogenous locus in a mammalian cell. Dimer pairs as shown were nucleofected into K562 cells using the Amaxa Biosystems device (Cologne, Germany) with standards methods as supplied by the manufacturer and subjected to a transitory cold shock growth condition following transfection (see, U.S. Patent Publication No. 20110129898).

Figure 16:
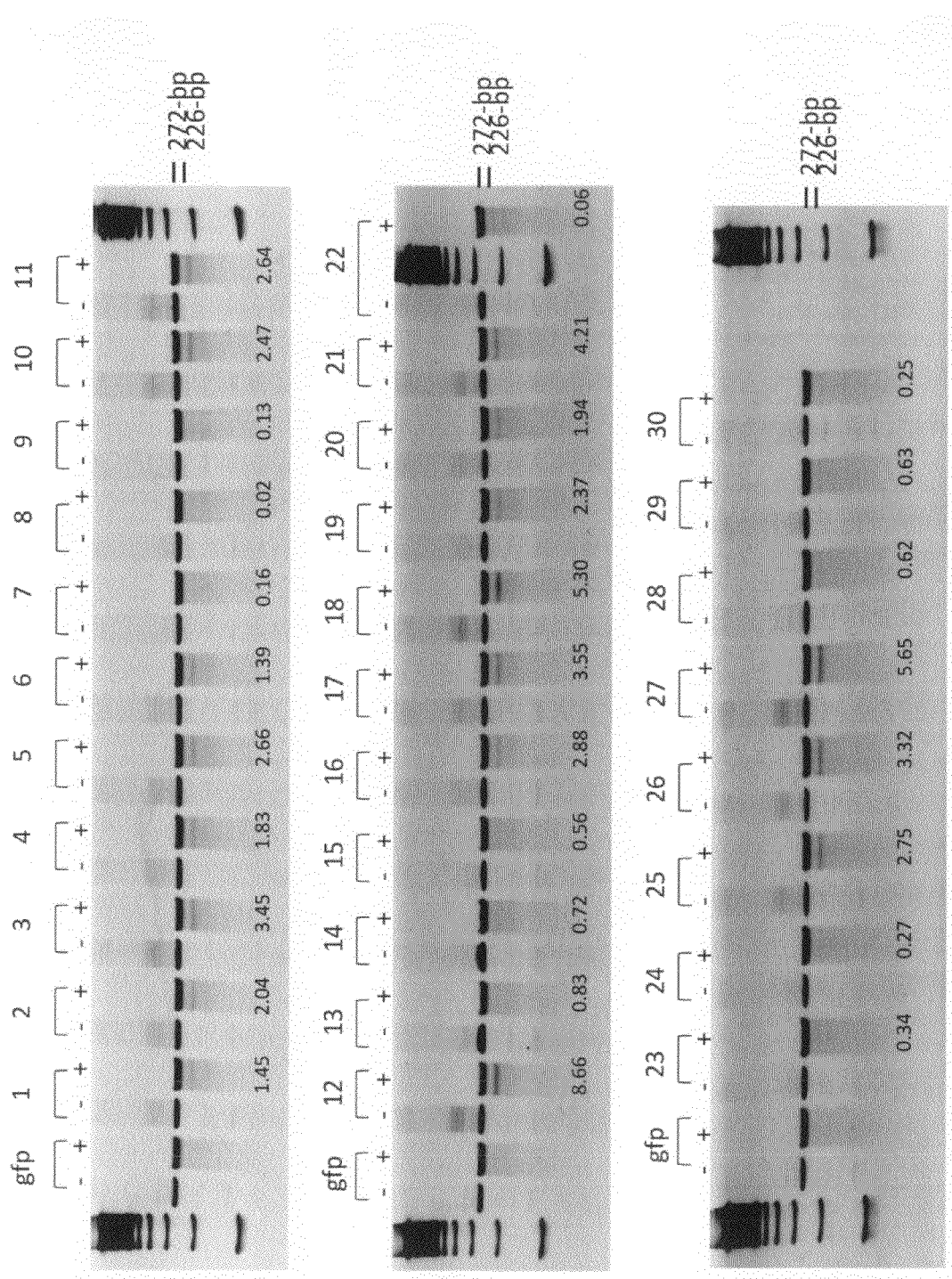
FIG. 16 depicts the results of a Cel-I Surveyor™ mismatch assay (Transgenomics, "Cel-I assay") on cells treated with various pairs of NTF3-targeting TALENs. The samples, numbered 1-30 are as described in the text. (+) denotes addition of the Cel-I enzyme, (−) denotes the assay without any added enzyme. A band of approximately 226 bp is apparent in most of the samples, indicating a mismatch induced by cleavage of the endogenous NTF3 target by the nuclease, followed by non-homologous end joining which introduces areas of mismatch with the wild type sequence. "gfp" indicates the control where cells were transfected with a GFP encoding plasmid only. The percent NHEJ activity quantitated on the gel is indicated in each sample containing the Cel-I enzyme. The gel demonstrates that the pairs induced targeted locus disruption at up to 8.66% of total alleles in some samples at this endogenous locus in a mammalian cell.

Cells were incubated at 30° C. for three days and then the DNA isolated and used for Cel-I analysis. This assay is designed to detect mismatches in a sample as compared to the wild type sequence. The mismatches are a result of a double strand break in the DNA due to cleavage by the TALEN that are healed by the error prone process of non-homologous end joining (NHEJ). NHEJ often introduces small additions or deletions and the Cel-I assay is designed to detect those changes. Assays were done as described, for example, in U.S. Patent Publication Nos. 20080015164; 20080131962 and 20080159996, using the products amplified with the following primers: LZNT3-F4: 5'-GAAGGGGTTAAGGCGCT-GAG-3' (SEQ ID NO:80) and LZNT3-1077R: 5'-AGG-GACGTCGACATGAAGAG-3' (SEQ ID NO:81). These primers amplify a 272 bp amplicon from the endogenous sequence, and cleavage by the Cel-I assay will produce products of approximately 226 and 46 bp. While the 226 bp products are visible, the 46 bp products are difficult to see on the gel due to their size. The results are shown in FIG. 16 where the percent genome modification observed is indicated in the lanes that include the Cel-I enzyme. As is evident from the Figure, there are nuclease-induced mutations occurring in these samples, and the samples are reproducible in duplicate (e.g. compare lanes 7 and 22, or lanes 12 and 27).

Figure 17:
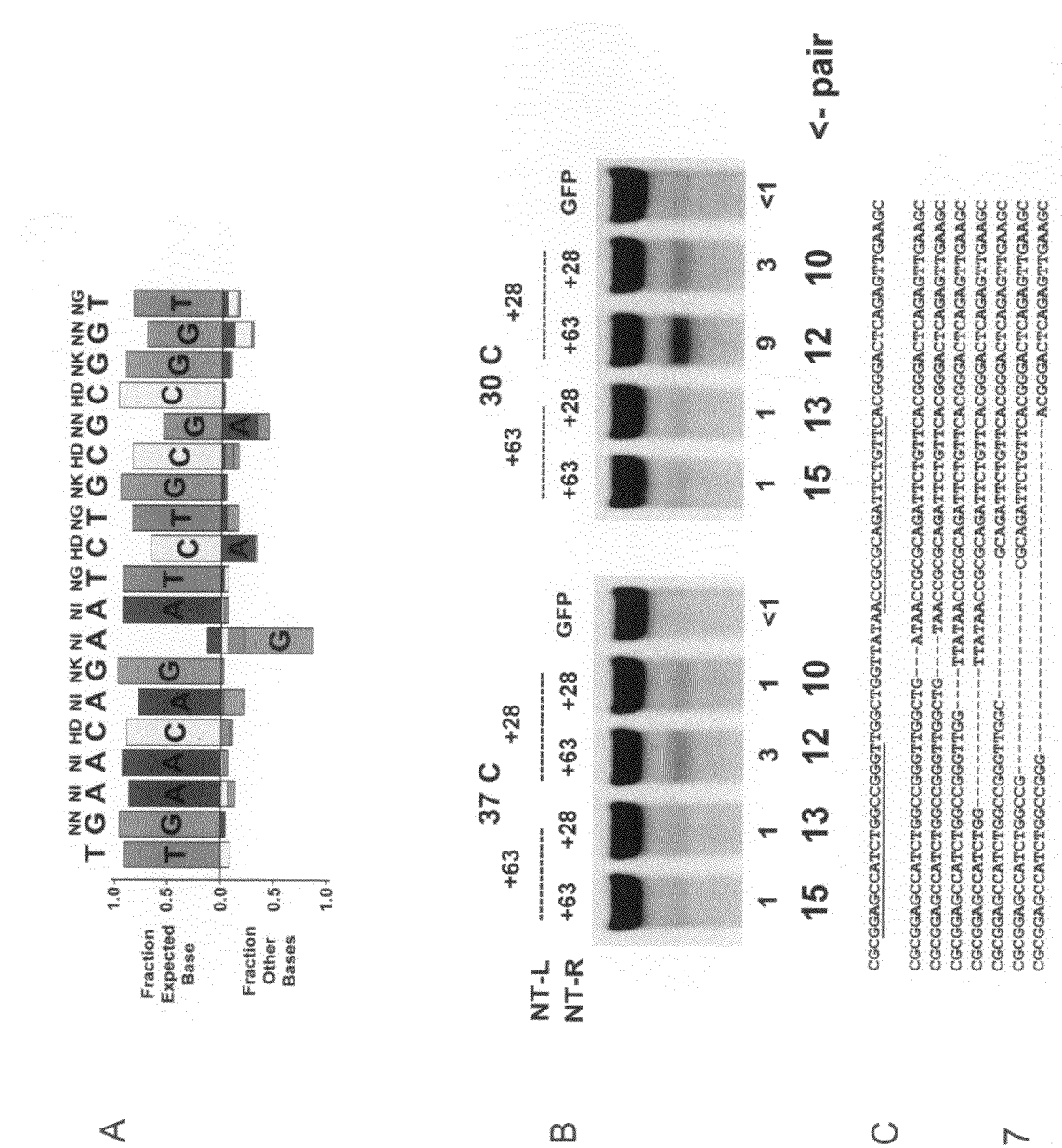
FIG. 17, panels A through C, depict the activity of NTF3-specific TALENs in K562 cells.

The studies were repeated with pairs 15, 13, 12, and 10 (see Table 18), using cells that were incubated at either a 37° C. or 30° C. after transfection, and the results are shown in FIG. 17. First, the NT-R TALE DNA binding domain was tested in the SELEX assay as previously described and the results are shown in FIG. 17A. When expressed in K562 cells, these proteins yielded robust gene modification as revealed by the Cel-I assay, with estimated levels of 3% and 9% for the most active heterodimer (pair 12) tested at 37° C. and 30° C. (see FIG. 17B). Moreover Sanger sequencing identified 7 mutated alleles out of 84 analyzed in the 30° C. sample and also revealed a mutation spectrum (minor deletions) consistent with error-prone break repair via non-homologous end joining (NHEJ) (FIG. 17C).

These studies show that TALEN architecture as described herein can drive efficient NHEJ-mediated gene modification at an endogenous locus and in a mammalian cell.

Figure 18:
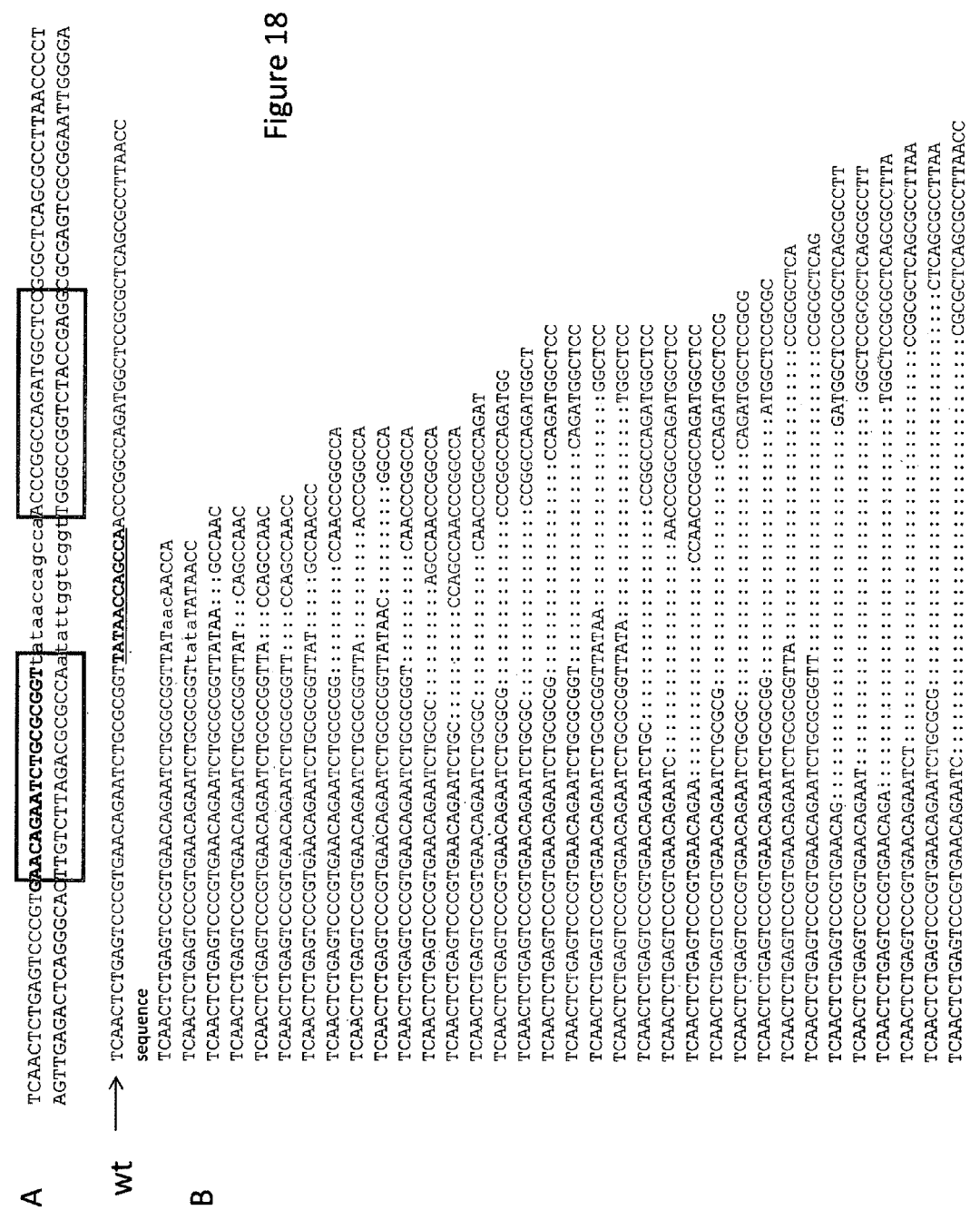

These studies also reveal compositions that may be used to link a nuclease domain to a TALE repeat array that provides highly active nuclease function. The samples were also subjected to deep sequencing at the NTF3 locus. Samples were barcoded with a 4 bp sequence and a 50 bp read length was used on an Illumina Genome Analyzer instrument (Illumina, San Diego Calif.). Sequences were processed with a custom python script. Sequences were analyzed for the presence of additions or deletions ("indels") as hallmarks of non-homologous end joining (NHEJ) activity as a result of a double stranded break induced by nuclease activity. The results are presented in FIG. 18. In the endogenous locus, there is a 12 base pair gap between the target sequences recognized by these two proteins (see FIG. 18A). As shown in FIG. 18B, there are numerous indels that demonstrate activity against the endogenous NTF3 locus in a mammalian cell. In FIG. 18B, the wild type sequence at the endogenous locus is indicated by "wt".

Example 9

Targeted Integration into an Endogenous Locus Following TALEN Cleavage

TALE-mediated targeted integration at NTF3 could happen via the HDR DNA repair pathway or via the NHEJ pathway. We designed an experiment to assay TALE-mediated targeted integration at NTF3 based on the capture of a small double-stranded oligonucleotide by NHEJ. We have previously shown capture of oligonucleotides at the site of ZFN-induced DNA double-strand breaks (DSBs). This type of targeted integration was enhanced by (but did not absolutely require) the presence of 5' overhangs complementary to those created by the FokI portions of the ZFN pair. FokI naturally creates 4 bp 5' overhangs; in the context of a ZFN, the FokI nuclease domain creates either 4 bp or 5 bp 5' overhangs. Since the position and composition of the overhangs left by NTF3 TALENs is unknown, we designed nine double-stranded oligonucleotide donors with all possible 4 bp 5' overhangs in the 12 bp spacer region between the NTF3 TALEN binding sites (NT3-1F to NT3-9R). (see Table 20).

TABLE 20

PCR primers used for Targeted Integration assay

| Name | Sequence | | PCR band size |
|---|---|---|---|
| NT3-1F | 5' T*G *GCGTACGGATCCAAGCTTCGTCGACCTAGCC 3' | (SEQ ID NO: 82) | 461 bp |
| NT3-1R | 5' G*C *CAGGCTAGGTCGACGAAGCTTGGATCCGTAC 3' | (SEQ ID NO: 83) | |
| NT3-2F | 5' G*G *CTGTACGGATCCAAGCTTCGTCGACCTAGCC 3' | (SEQ ID NO: 84) | 462 bp |
| NT3-2R | 5' A*G *CCGGCTAGGTCGACGAAGCTTGGATCCGTAC 3' | (SEQ ID NO: 85) | |
| NT3-3F | 5' G*C*TGGTACGGATCCAAGCTTCGTCGACCTAGCC 3' | (SEQ ID NO: 86) | 463 bp |
| NT3-3R | 5' C*A*GCGGCTAGGTCGACGAAGCTTGGATCCGTAC 3' | (SEQ ID NO: 87) | |
| NT3-4F | 5' C*T*GGGTACGGATCCAAGCTTCGTCGACCTAGCC 3' | (SEQ ID NO: 88) | 464 bp |
| NT3-4R | 5' C*C*AGGGCTAGGTCGACGAAGCTTGGATCCGTAC 3' | (SEQ ID NO: 89) | |
| NT3-5F | 5' T*G*GTGTACGGATCCAAGCTTCGTCGACCTAGCC 3' | (SEQ ID NO: 90) | 465 bp |
| NT3-5R | 5' A*C*CAGGCTAGGTCGACGAAGCTTGGATCCGTAC 3' | (SEQ ID NO: 91) | |
| NT3-6F | 5' G*G*TTGTACGGATCCAAGCTTCGTCGACCTAGCC 3' | (SEQ ID NO: 92) | 466 bp |
| NT3-6R | 5' A*A*CCGGCTAGGTCGACGAAGCTTGGATCCGTAC 3' | (SEQ ID NO: 93) | |
| NT3-7F | 5' G*T*TAGTACGGATCCAAGCTTCGTCGACCTAGCC 3' | (SEQ ID NO: 94) | 467 bp |
| NT3-7R | 5' T*A*ACGGCTAGGTCGACGAAGCTTGGATCCGTAC 3' | (SEQ ID NO: 95) | |
| NT3-8F | 5' T*T*ATGTACGGATCCAAGCTTCGTCGACCTAGCC 3' | (SEQ ID NO: 96) | 468 bp |
| NT3-8R | 5' A*T*AAGGCTAGGTCGACGAAGCTTGGATCCGTAC 3' | (SEQ ID NO: 97) | |
| NT3-9F | 5' T*A*TAGTACGGATCCAAGCTTCGTCGACCTAGCC 3' | (SEQ ID NO: 98) | 469 bp |
| NT3-9R | 5' T*A*TAGGCTAGGTCGACGAAGCTTGGATCCGTAC 3' | (SEQ ID NO: 99) | |
| Internal F | 5' GGATCCAAGCTTCGTCGACCT 3' (SEQ ID NO: 100) | | |
| GJC 273R | 5' CAGCGCAAACTTTGGGGAAG 3' (SEQ ID NO: 101) | | |

Note
*in the primer sequence indicates the two 5' terminal phosphorothioate linkages. All primers lack 5' phosphates.

These donors contain two 5' terminal phosphorothioate linkages and lack 5' phosphates, and a binding site for the primer Internal F. Complementary oligonucleotides (NT3-1F with NT3-1R, e.g.) were annealed in 10 mM Tris pH 8.0, 1 mM EDTA, 50 mM NaCl by heating to 95° and cooling at 0.1°/min to room temperature. Donor oligonucleotides (5 µL of 40 µM annealed oligonucleotide) were individually transfected with each of eight different TALEN pairs (A-H, 400 ng each plasmid, see Table 21) in a 20 µL transfection mix into 200,000 K562 cells using an Amaxa Nucleofector (Lonza) set to program FF-120 and using solution SF.

TABLE 21

NT3-specific TALEN pairs

| Pair | TALEN 1 | TALEN 2 |
|---|---|---|
| A | NT3 R10 C28 | rNT3 C39 |
| B | NT3 R10 C28 | rNT3 C63 |
| C | NT3 R10 C39 | rNT3 C28 |
| D | NT3 R10 C39 | rNT3 C39 |
| E | NT3 R10 C39 | rNT3 C63 |
| F | NT3 R18 C28 | rNT3 C28 |
| G | NT3 R18 C28 | rNT3 C39 |
| H | NT3 R18 C28 | rNT3 C63 |

Cells were harvested three days post-transfection and lysed in 50 µL QuickExtract solution (Epicentre). One microliter of the crude lysate was used for PCR analysis as described below.

Figure 19:
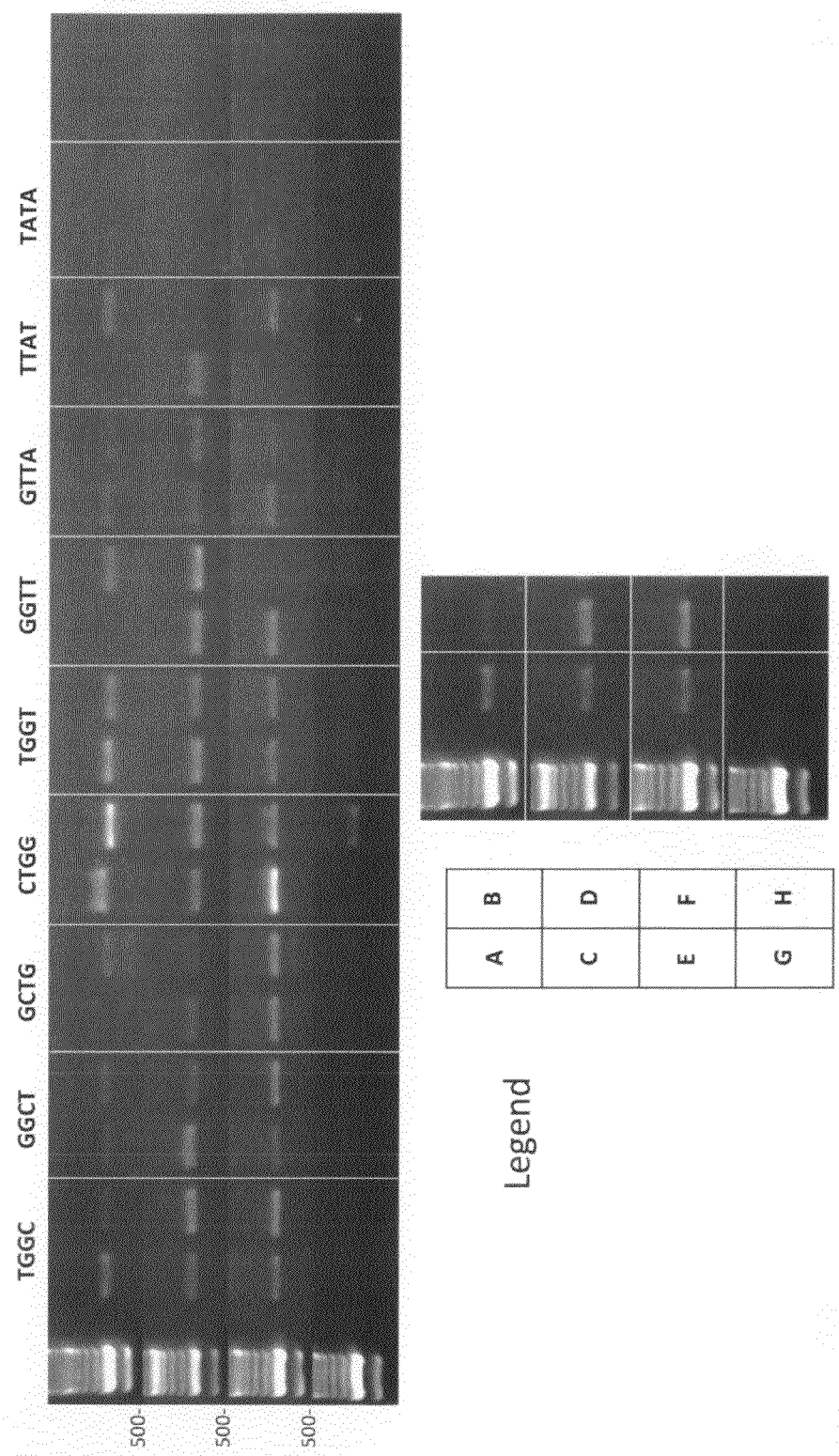
FIG. 19 depicts the results of a targeted integration event at an endogenous gene via a DSB induced by the NTF3-specific TALENs. Oligonucleotides for capture in the DSB were synthesized to contain overhangs corresponding to all possible sequences within the space between the TALEN binding sites. PCR was done using a set of primers that primed off of the inserted oligonucleotide and a region outside the putative cut site. Eight (8) different pairs of NTF3-specific TALENs were tested wherein the pairs are labeled A-H. The legend shows a portion of the gel demonstrating how the lanes are read.
Figure 20:
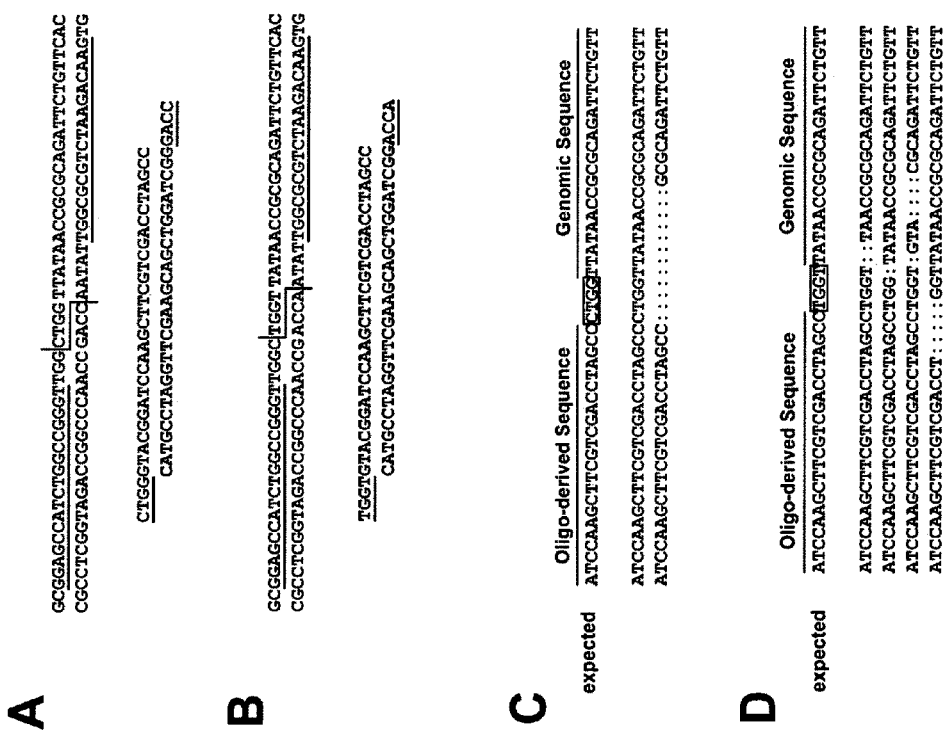
FIG. 20, panels A to D, show capture of an oligonucleotide duplex at an endogenous chromosomal locus mediated by NHEJ following a DSB induced at that locus by a TALEN pair.

We assayed targeted integration of the oligonucleotide donor into the DSB created by the NTF3 TALEN by PCR amplification of the junction created by the oligonucleotide and the chromosome using the Internal F and GJC 273R primers. The expected size of the PCR amplicon based on perfect ligation of the oligonucleotide donor varies depending on the position of the break in the chromosome. As can be seen in FIG. 19, integration of the donor was detected with many combinations of TALEN and donor overhangs. Maximal signal was seen with the CTGG and TGGT overhangs near the center of the 12 bp spacer region. Endogenous chromosomal loci containing donors captured by NHEJ were sequenced and are shown in FIG. 20. The NTF3 target locus (top duplex) and one of the oligonucleotide duplexes used for this study (bottom duplex) are shown and the binding sites for NT-L+28 and NT-R+63 are underlined in the top sequence. The cleavage overhang that will most efficiently capture the duplex (5' CTGG) is also highlighted. Also shown in FIG. 20B is a second oligonucleotide duplex used for this study. Binding sites for NT-L+28 and NT-R+63 are underlined in the top sequence. The cleavage overhang that will most efficiently capture this second duplex (5' TGGT) is also shown. The TALENs NT-L+28 and NT-R+63 were then expressed in K562 cells in the presence of the oligonucleotide duplex shown in FIG. 20A. Junctions between successfully integrated duplex and genomic DNA were then amplified using one primer that anneals within the duplex and one primer that anneals to the native NTF3 locus. The resulting amplicons were cloned and sequenced. The "expected" sequence in FIG. 20C indicates the sequence that would result from a perfect ligation of oligonucleotide duplex to the cleaved locus. The box highlights the location of the duplex overhang in the junction sequences. The bottom two lines provide junction sequences obtained from this study. As shown; eleven junction sequences resulted from perfect ligation of duplex to the cleavage overhang, while one junction sequence exhibited a short deletion (12 bp) consistent with resection prior to repair by NHEJ. FIG. 20D shows results from experiments as shown in FIG. 20C except that the oligonucleotide duplex shown in FIG. 20B was used, which has a 4 bp overhang that is shifted by one base relative to the duplex shown in FIG. 20A. The lowest four lines provide junction sequences obtained from this study. As shown, four distinct sequences were identified, which each exhibit short deletions consistent with resection prior to NHEJ-mediated repair.

Example 10

Efficient Assembly of Genes that Encode Novel TALE Proteins

Figure 21:
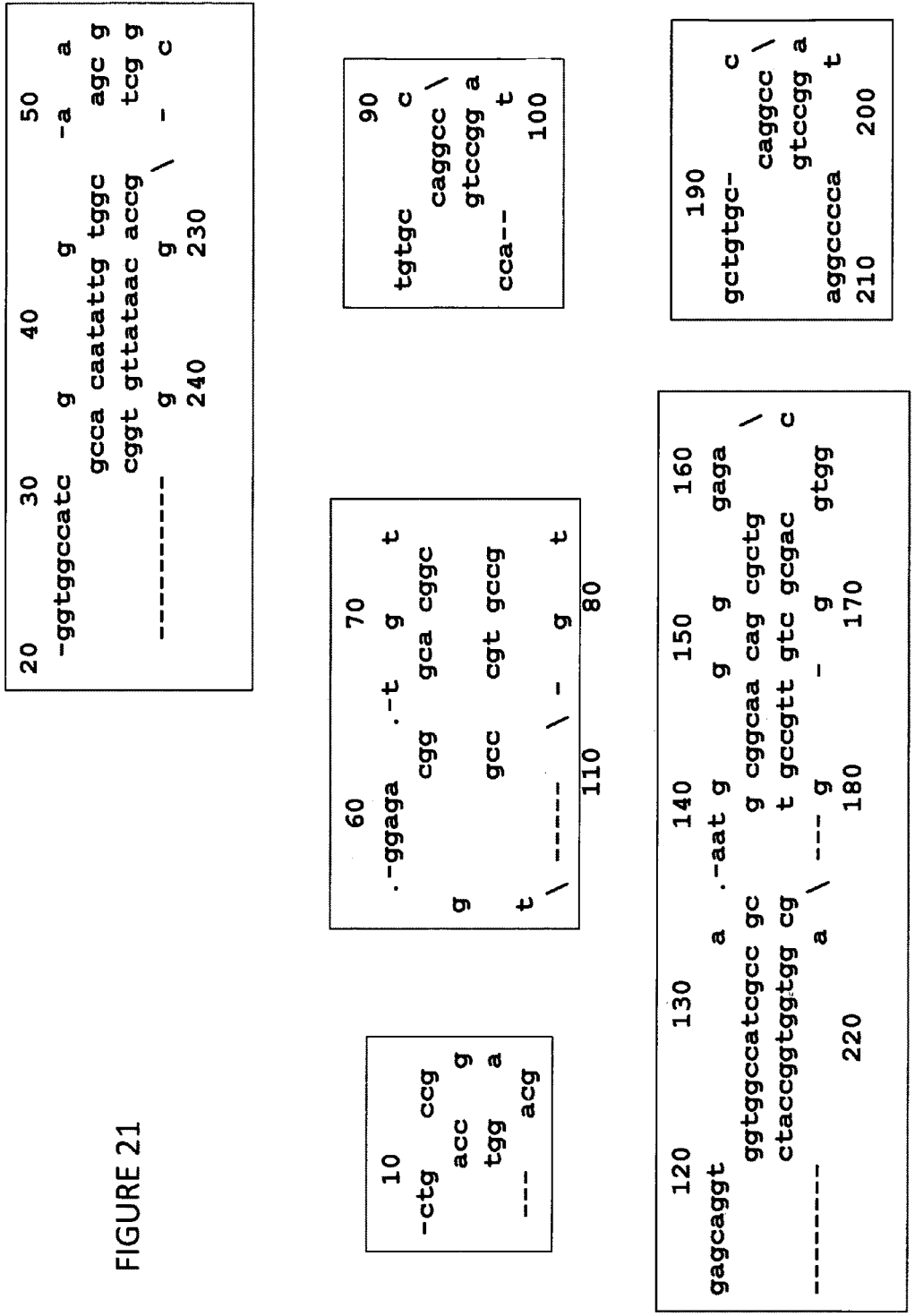
FIG. 21 depicts several of the potential secondary DNA structures predicted to form in the natural TALE repeat domain during PCR amplification that can disrupt efficient amplification of the template. Analysis of the DNA sequence of the TALE-repeat protein was done using Mfold (M. Zuker *Nucleic Acids Res.* 31(13):3406-15, (2003)). 800 base pairs of the nucleic acid sequence were analyzed starting at the 5' end of the nucleic acid encoding the first full TALE repeat sequence. The sequence analyzed contained approximately 7.5 repeats. Analysis revealed several very stable secondary, structures.

The DNA sequence encoding TALE repeats found in natural proteins is as repetitive as their corresponding amino acid sequence. The natural TALE typically have only a few base pairs' worth of difference between the sequences of each repeat. Repetitive DNA sequence can make it difficult to efficiently amplify the desired full-length DNA amplicon. This has been shown when attempting to amplify DNA for natural TALE-containing proteins. Further analysis of the DNA sequence of the TALE-repeat protein above using Mfold (M. Zuker *Nucleic Acids Res.* 31(13):3406-15, (2003)) revealed that not only do they have repetitive sequence disrupting efficient amplification, but also that they contain very stable secondary structure. In this analysis, 800 base pairs of sequence were analyzed starting at the 5' end of the nucleic acid encoding the first full repeat sequence. Thus, the nucleic acid sequence analyzed contained approximately 7.5 repeat sequences. Several of these secondary structures are shown in FIG. 21.

These structures can occur between any of the TALE repeats or between repeats that are not adjacent. To provide efficient amplification of DNA sequences containing TALE repeats, introduction of silent mutations to disrupt this secondary structure and bias the reaction towards the full-length amplicon were made in the regions of the TALE repeats that serve to stabilize the secondary structure. Primers were then made to allow efficient amplification of the TALE sequence or interest. The PCR amplification product was then sequenced for verification and cloned for use in fusion proteins. In addition, silent mutations were made in the TALE nucleotide sequence for codon optimization in mammalian cells. Similar codon optimization can be used for optimal expression in other host cell systems (e.g. plant, fungal etc.).

Example 11

Method for Rapid Construction of Genes Encoding TALE Fusion Proteins

To allow for the rapid assembly of a variety of TALE fusion proteins, a method was developed to create an archive of repeat modules which could be linked together to create a TALE DNA binding domain specific for nearly any chosen target DNA sequence. Based on the desired target DNA sequence, one or more modules are picked and are retrieved via a PCR based approach. The modules are tandemly linked and ligated into a vector backbone containing the fusion partner domain of choice.

Modules containing four TALE repeat units were constructed with specificity for each of the 256 possible DNA tetranucleotide sequence (for example, one module for the AAAA target, one for AAAT etc.). In addition, modules were also created for all 64 possible DNA trinucleotide targets, all possible 64 dinucleotide DNA targets as well as 4 single nucleotide targets. For the dipeptide recognition region (also referred to as an RVD—Repeat Variable Dipeptide), the following code was used: For recognition of Adenine, the RVD was NI (asparagine-isoleucine), for Cytosine, the RVD was HD (histadine-aspartate), for Thymine, the RVD was NG (asparagine-glycine), and for R (comparable specificity for Guanine or Adenine), the RVD was NN (asparagine-asparagine). In addition, in some engineered TALEs, the RVD NK (asparagine-lysine) was chosen for recognition of G because it appeared to give higher specificity for G than NN in some proteins. Furthermore, the penultimate position N-terminal of the RVD (position 11 of the repeat unit) was N or asparagine (typically this position is an S or serine). This module archive can be expanded by using any other RVDs.

Figure 22:
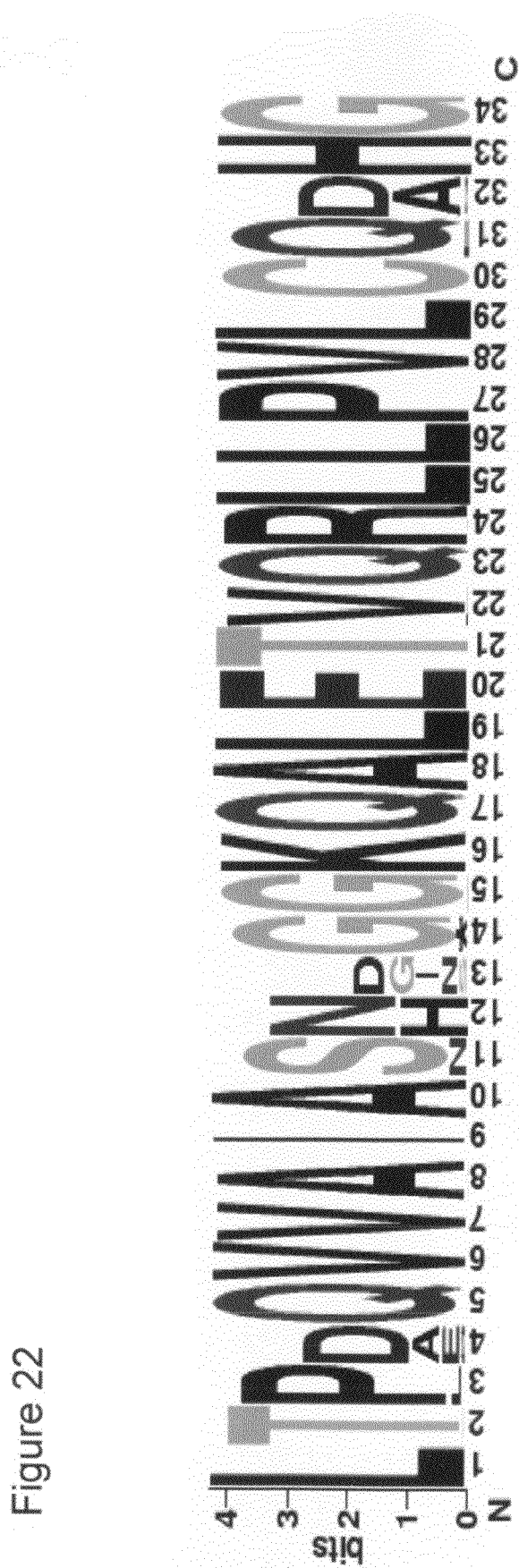
FIG. 22 depicts pictoral results of in silico analysis of 1963 TALE repeats from *Xanthomonas* bacteria displaying the conserved amino acids at each position in the 34 amino acid repeat unit (SEQ ID NO. 461). Letter size is inversely related to observed diversity at any given position: larger letters indicate less tolerance of diversity while smaller letters indicate the alternate amino acids that can be observed at a given location. Different shades of color represent different chemical classes of the amino acids. In this sample of 1963 TALE repeats, the most frequency RVDs were: 28.8% HD; 20.6% NI, 15.1% NN; 13.2% NG; 8.5% NS; 5.5% HG; and 5.5%

The PCR specificity, cloning and manipulation of DNA bearing perfect sequence repeats is problematic. Thus, in order to construct the archive, many natural TALE repeat sequences were analyzed to see where variability in amino acid sequence could be tolerated in an attempt to diversify repeat sequences at the DNA level. The results are depicted in FIG. 22, where letter size is inversely related to observed diversity at a given position: larger letters indicate less tolerance of diversity while smaller letters indicate positions where other amino acids are sometimes observed. For example, at position 1, the first amino acid of the repeat unit, an L, or leucine is essentially invariantly observed. However, at position 4, three different amino acids are sometimes found: an E, or glutamate, an A, or alanine, or a D, or aspartate. In addition, the nucleotide sequence encoding the various repeat modules was also altered to exploit the redundancy in the genetic code such that codons encoding specific amino acids may be interchanged allowing the DNA strand encoding the repeat unit to have a different sequence from another repeat unit, but the amino acid sequence will remain the same. All of these techniques were utilized to pools of modules that could be used to construct engineered TALE DNA binding domains where the interior of the DNA binding domain could recognize any desired target.

To allow the designer to specify the position of the modules, a type II S restriction enzyme was used, BsaI, which cleaves to the 3' end of its DNA target site. BsaI recognizes the sequence shown below. Also illustrated are the "sticky ends" (SEQ ID NOs:102-105) of the cleaved DNA left following enzymatic cleavage:

```
5'...GGTCTCNNNNN...3'      5'...GGTCTCN   NNNNN...3'
5'...CCAGAGNNNNN...3'      5'...CCAGAGNNNNN N...3'
     Recognition site ->            After cleavage
```

As will be appreciated by the artisan, the sequence of the sticky ends is dependent upon the sequence of the DNA immediately 3' of the restriction recognition site, and thus the ligation of those sticky ends to each other will only occur if the correct sequences are present. This was exploited to develop PCR primers to amplify the desired modules that would have known sticky ends once the PCR amplicons were cleaved with BsaI. The PCR products were then combined following BsaI cleavage to allow ligation of the products together in only the order specified by the user. An assembly scheme to ligate up to four modules that consist of 1 to 16 full TALE repeats is depicted in FIG. 23. The primers used were as follows where the numbering corresponds to that shown in the Figure. While the listed primers are intended to be used to ligate up to four modules, by using the same concept, more primers can be added in order to ligate more than four modules.
Primers:

T1F-Bsa
(SEQ ID NO: 106)
GGATCCGGATGGTCTCAACCTGACCCCAGACCAG

T1R-Bsa
(SEQ ID NO: 107)
GAGGGATGCGGGTCTCTGAGTCCATGATCCTGGCACAGT

-continued
T2F-Bsa
(SEQ ID NO: 108)
GGATCCGGATGGGTCTCAACTCACCCCAGACCAGGTA

T2R-Bsa
(SEQ ID NO: 109)
GAGGGATGCGGGTCTCTCAGCCCATGATCCTGGCACAGT

T3F-Bsa
(SEQ ID NO: 110)
GGATCCGGATGGGTCTCAGCTGACCCCAGACCAG

T3R-Bsa
(SEQ ID NO: 111)
GAGGGATGCGGGTCTCTCAAACCATGATCCTGGCACAGT

T4F-Bsa
(SEQ ID NO: 112)
GGATCCGGATGGGTCTCATTTGACCCCAGACCAGGTA

T4R-Bsa
(SEQ ID NO: 113)
CTCGAGGGATGGTCTCCTGTCAGGCCATGATCC

When using this method, the ligation of the BsaI cleaved PCR amplicons can only occur where the 3' end of the "A" module ligates to the 5' end of the "B" module, the 3'end of the "B" module can only ligate to the 5' end of the "C" module etc. In addition, the vector backbone that the ligated modules are cloned into also contains specific BsaI cleaved sticky ends, such that only the 5' end of the "A" module, and only the 3' end of the "D" module will ligate to complete the vector circle. Thus, position of each module within the engineered TALE DNA binding domain is determined by the PCR primers chosen by the user.

At the current time, DNA target sites for TALE DNA binding domains are typically flanked by T nucleotides at the 5' end of the target (which is recognized by the R0 repeat) and at the 3' end of the target (which is recognized by the R1/2 repeat). Thus, the vector backbone has been designed such that the ligated PCR amplicons containing the specified modules are cloned in frame between R0 and R1/2 sequences within the vector. In addition, the vector contains the user specified C-terminal domain type (truncated or not) of the TALE protein and the exogenous domain of choice for fusion partner. In the design depicted in FIG. 23, the exogenous domain is a FokI domain, allowing for the production of a TALE nuclease. The vector further contains sequences necessary for expression of the fusion protein such as a CMV promoter, a nuclear localization signal, a tag for monitoring expression, and a poly A site. This vector can now be transfected into a cell of the user's choice. In addition, the vector can be further modified to contain selection markers, domains or other genes as desired and/or required for different cellular systems.

Example 12

Design and Characterization of Specific Endogenous TALENs

To evaluate the TALEN design method, we sought to demonstrate TALEN mediated gene modification near the position of the delta 32 mutation (shown below in Bold underline) within the human CCR5 gene (see Stephens J C et al, (1998) *Am J Hum Gen* 62(6): 1507-15). For this study, we designated a cluster of four "left" and four "right" binding sites at the location of delta 32 (see below), which defined a panel of 16 dimer targets (SEQ ID NO:114-123, respectively, in order of appearance).

```
L532         5'CTTCATTACACCT
L538             5'TCATTACACCTGCAGCT
L540                 5'ACACCTGCAGCTCT
L543                 5'ACACCTGCAGCTCTCAT
5' AAAAAGAAGGTCTTCATTACACCTGCAGCTCTCATTTTCCATACAGTCAGTATCAATTCTGGAAGAATTTCCAGACATT
   TTTTTCTTCCAGAAGTAATGTGGACGTCGAGAGTAAAAGGTATGTCAGTCATAGTTAAGACCTTCTTAAAGGTCTGTAA 5'
R549                                     TATGTCAGTCATAG 5'
R551                                       TGTCAGTCATAGT 5'
R557                                           TCATAGTTAAGACCTTC 5'
R560                                             TAGTTAAGACCTTCT 5'
```

Within this panel, individual targets were separated by a range of gap sizes—from 5-27 bp. TALEN proteins were assembled using the methods described in Example 11, such that in all proteins described (unless specifically noted), the RVD specifying was NG, for 'A' was NI, for 'C' was HD and for 'G' was NN. Next, two alternative proteins were generated for each target, bearing a C-terminal segment of either 48 or 83 residues. Finally, all pairwise combinations of "left" and "right" proteins (8×8=64 total) were expressed in K562 cells and assayed for modification of the endogenous locus. See Table 22 below (day 3 and day 10):

TABLE 23

Gap sizes for pairwise combinations

|  | R549 | R551 | R557 | R560 |
|---|---|---|---|---|
| L532 | 16 bp | 18 bp | 24 bp* | 27 bp* |
| L538 | 10 bp* | 12 bp | 18 bp | 21 bp |
| L540 | 8 bp* | 10 bp* | 16 bp | 19 bp |
| L543 | 5 bp* | 7 bp* | 13 bp | 16 bp |

*indicates pairings where there was <1% gene correction activity as assayed by the Cel I assay (compare to Table 22, +63/+63)

TABLE 22

Pairwise combinations of activity for CCR5 Δ32-specific TALEN truncations

Day 3 modification levels

| | | | Right Nuclease | | | | | | | |
|---|---|---|---|---|---|---|---|---|---|---|
| | | | +28 | | | | +63 | | | |
| | | | R549 | R551 | R557 | R560 | R549 | R551 | R557 | R560 |
| Left Nuclease | +28 | L532 | <1 | <1 | <1 | <1 | <1 | <1 | <1 | <1 |
| | | L538 | 2% | 21% | 2% | 3% | <1 | 12% | 26% | 21% |
| | | L540 | <1 | <1 | <1 | <1 | <1 | <1 | 5% | <1 |
| | | L543 | <1 | <1 | 10% | <1 | <1 | <1 | 21% | 12% |
| | +63 | L532 | <1 | <1 | <1 | <1 | 15% | 8% | <1 | <1 |
| | | L538 | <1 | 6% | 30% | 24% | <1 | 5% | 27% | 21% |
| | | L540 | <1 | <1 | 20% | 14% | <1 | <1 | 24% | 19% |
| | | L543 | <1 | <1 | 20% | 6% | <1 | <1 | 12% | 24% |

Day 10 modification levels

| | | | Right Nuclease | | | | | | | |
|---|---|---|---|---|---|---|---|---|---|---|
| | | | +28 | | | | +63 | | | |
| | | | R549 | R551 | R557 | R560 | R549 | R551 | R557 | R560 |
| Left Nuclease | +28 | L532 | | | | | | | | |
| | | L538 | 3% | 15% | 3% | 3% | | 5% | 21% | 18% |
| | | L540 | | | | | | | 3% | |
| | | L543 | | | 11% | | | | 20% | 11% |
| | +63 | L532 | | | | | 11% | 4% | | |
| | | L538 | | 5% | 23% | 23% | | 3% | 26% | 17% |
| | | L540 | | | 12% | 9% | | | 28% | 13% |
| | | L543 | | | 16% | 5% | | | 12% | 15% |

Since the target sites contained a variety of gap sizes, data concerning the most active nucleases can also be analyzed with respect to the distance between the two target sites. Shown below in Table 23 is a similar panel to those above in Table 22, except that it shows the gap sizes for the target sites.

Thus, the data from Table 22 and Table 23 can be compared to determine that the range of gap sizes where these pairs are most active includes 12 to 21 bp but excludes gaps of less than 11 bp or more than 23 bp.

To demonstrate that our TALEN architecture could induce gene editing via the other major cellular DNA repair pathway:

homology directed repair (HDR), a second locus within CCR5 (termed locus 162) that had shown promise in prior studies as a potential safe-harbor for transgene integration (see Lombardo et al (2007) *Nat Biotechnol* 25: 1298-1306) was targeted. Four "left" and four "right" right binding sites were designated (see below), and two alternative TALENs were constructed for each (the +28 and +63 variants), and the +28/+28 and +63/+63 pairings were screened for NHEJ-mediated gene modification using the Cel-I assay (SEQ ID NOs: 370-379, respectively, in order of appearance).

```
L161                         5'GCTGGTCATCCTCAT
L164                         5'GGTCATCCTCATCCT
L167                           5'CATCCTCATCCTGAT
L172                             5'CCTCATCCTGATAAACT
     5' TGGTTTTGTGGGCAACATGCTGGTCATCCTCATCCTGATAAACTGCAAAAGGCTGAAGAGCATGACTGACATC
        ACCAAAACACCCGTTGTACGACCAGTAGGAGTAGGACTATTTGACGTTTTCCGACTTCTCGTACTGACTGTAG 5'
R175                                                       TTTTCCGACTTCTCG 5'
R177                                                         TTCCGACTTCTCG 5'
R178                                                          TCCGACTTCTCGTAC 5'
R185                                                             TCTCGTACTGACTG 5'
```

As shown below in Table 24, of the 24 pairs tested, 16 yielded detectable modification at levels of up to 21%.

TABLE 24

Activity of pairwise combinations of TALEN pairs targeted to locus 162 of CCR5

| | % gene modification: | | | | | | | | |
|---|---|---|---|---|---|---|---|---|---|
| | +28/+28 pairs | | | | | +63/+63 pairs | | | |
| | R175 | R177 | R178 | R185 | | R175 | R177 | R178 | R185 |
| L161 | 2% | <1 | <1 | 3% | L161 | 4% | 18% | 12% | 8% |
| L164 | <1 | 3% | 7% | 2% | L164 | <1 | <1 | 16% | 6% |
| L167 | | <1 | 1% | 2% | L167 | | <1 | <1 | 6% |
| L172 | | | | 21% | L172 | | | | 5% |

Next, the two most active pairs (L172+28/R185+28 and L161+63/R177±63) were introduced into K562 cells with a donor DNA fragment designed to transfer 46 bp insertion bearing a BglII restriction site into the targeted locus. The donor sequence used is shown in Example 23.

Following insertion, the incorporated tag donor sequence was 5'-5'TCATCTTTGGTTTTGTGGGCAACAT-GCTGGTCATCCTCATCTAGATCAGTGAGTAT GCCCT-GATGGCGTCTGGACTGGATGC-CTCGTCTAGAAAACTGCAAAAGGCTGAAGA GCATGACTGACATCTACCTGCTCAAC-3' (SEQ ID NO:177) with the unique BglI restriction site being underlined.

If donor insertion occurred via HDR, the region containing the insert site can be PCR amplified and then subject to BglI digestion, as is shown below where the top strand shows the sequence of the target site (SEQ ID NO:133) and the bottom strand (SEQ ID NO:134) shows the sequence of a target had the tag donor inserted. The underlined sequence in the top strand shows the TALEN binding site while the underlined sequence in the bottom strand shows the BglI restriction site:

As shown in FIG. 24, PCR products of clones containing an insert had two fragments following BglI digestion. The PCR and BglI digestion scheme is shown in FIG. 24A, while the results are shown in FIG. 24B, and revealed highly efficient editing. Thus, our TALEN architecture induced efficient gene modification via HDR at an endogenous locus.

Example 13

Examination of Gap Spacing Preferences for Selected TALEN Architectures

To examine the gap spacing preferences of two preferred TALEN architectures (C+28 C-cap or C+63 C-cap pairs), all TALEN pairs containing a pairing of C+28/C+28 or C+63/C+63 were sorted for activity according to gap spacing. The results are shown in FIG. 25, and demonstrate that the smaller TALEN proteins, the C+28/C+28 pair, have a more constrained gap spacing preference and are most active on targets wherein the target sequence are separated by gaps of 12 or 13 base pairs. Conversely, the larger TALEN proteins, the C+63/C+63 pairs, shown in FIG. 25B, are active on targets containing gap spacings ranging from 12-23 base pairs.

Example 14

Systematic Mapping of Compositions that May be Used to Link a Nuclease Domain to a TALE Repeat Array that Provide Highly Active Nuclease Function Systematic mapping of compositions that may be used to link a nuclease domain to a TALE repeat array that provide highly active nuclease function. Initially, one TALEN pair was chosen against a single target with a defined gap spacing between the two binding domains. The TALEN pair chosen was that described in Example 12 as the L538/R557 pair which were specific for the CCR5 gene and had an 18 base pair gap spacing. The deletions were made as described above such that a truncation series resulted in C-caps from C−2 to C+278.

```
                                                    (SEQ ID NO: 133)
5'-TCATCTTTGGTTTTGTGGGCAACATGCTGGTCATCCTCATC-----------------CTGAT----------
------------------AAACTGCAAAAGGCTGAAGAGCATGACTGACATCTACCTGCTCAAC-3'

(SEQ ID NP: 133)
5'-TCATCTTTGGTTTTGTGGGCAACATGCTGGTCATCCTCATC-----------------CTGAT----------
------------------AAACTGCAAAAGGCTGAAGAGCATGACTGACATCTACCTGCTCAAC-3'

(SEQ ID NP: 134)
5'-TCATCTTTGGTTTTGTGGGCAACATGCTGGTCATCCTCATCTAGATCAGTGAGTATGCCCTGATGGCGTCTGG
ACTGGATGCCTCGTCTAGAAAACTGCAAAAGGCTGAAGAGCATGACTGACATCTACCTGCTCAAC-3'
```

```
                                                                        (SEQ ID NO: 178)
          C-2    C+5   C+11  C+17 C+22   C+28         C+39               C+55    C+63
LTPEQVVAIASNGGGRPALESIVAQLSRPDPALAALTNDHLVALACLGGRPALDAVKKGLPHAPALIKRTNRRIPERTSHRVADH
           C-1

C+79           C+95            C+117
AQVVRVLGFFQCHSHPAQAFDDAMTQFGMSRHGLLQLFRRVGVTELEARSGTLPPASQRWDRILQASGMKRAKPSPTSTQTPDQA

C+153                  C+183                       C+213                 C+231
SLHAFADSLERDLDAPSPTHEGDQRRASSRKRSRSDRAVTGPSAQQSFEVRAPEQRDALHLPLSWRVKRPRTSIGGGLPDPGTPT

C+278
AADLAASSTVMREQDEDPFAGAADDFPAFNEEELAWLMELLPQ (residues 35-322 of SEQ ID NO: 132)
```

These truncations were then used to analyze nuclease activity in K562 cells using the Cel-I mismatch assay. The results (% NHEJ) are shown below in Table 25 and FIG. 26.

TABLE 25

Nuclease activity for fine mapping C-terminal truncations

| C-cap | Activity 30° | Activity 37° |
|---|---|---|
| C − 2 | 18.2% | 4.6% |
| C − 1 | 14.3% | 3.3% |
| C + 5 | 2.1% | 2.7% |
| C + 11 | 5.8% | 3.2% |
| C + 17 | 9.2% | 5.9% |
| C + 22 | 5.7% | 2.9% |
| C + 28 | 10.4% | 3.0% |
| C + 63 | 48.8% | 24.0% |
| C + 79 | 20.7% | 5.0% |
| C + 95 | 9.8% | 2.4% |
| C + 123 | 14.0% | 4.2% |
| C + 153 | 8.1% | 0.7% |
| C + 183 | 7.0% | 0.8% |
| C + 213 | 3.1% | 1.7% |
| C + 231 | 2.2% | 0.8% |
| C + 278 | 8.4% | 0.7% |

The data demonstrate that the peak activity for this nuclease pair against this endogenous target occurs when the C-cap is approximately C+63, in other words, when the peptide LTPEQVVAIASNGGGRPALESIVAQLSRPDPALAALTNDHLVALACLGGRPALDAVKKG LPHAPALIKRTNRRIPERTSHRVA (SEQ ID NO:451) is used to link the array of full-length TALE repeats to the FokI cleavage domain. In this experiment, the nucleases were tested in K652 cells as before and the cells were incubated either at 30° C. or 37° C. The rough estimate of the activity ratio of the C+63 C-cap compared to the C+278 was greater than 20 times in the 37° C. degree incubation and greater than 6 times for the 30° C. incubation.

To more finely characterize those compositions that may be used to link a nuclease domain to an array of full-length TALE repeats that enable highly active nuclease function at an endogenous locus, additional truncations were constructed. A fine series of truncations was assembled comprising 30 C-caps: C−41, C−35, C−28, C−21, C−16, C−8, C−2, C−1, C+5, C+11, C+17, C+22, C+28, C+34, C+39, C+47, C+55, C+63, C+72, C+79, C+87, C+95, C+109, C+123, C+138, C+153, C+183, C+213, C+231, and C+278. Note that our C-cap notation starts at residue −20. Thus C−41, C−35, C−28, and C−21 indicates a construct completely lacking a C-cap and with 20, 14, 7, or 0 residues removed from the C-terminus of the last full 34-residue TALE repeat. Pairs of the constructs were tested against the appropriate target sites with the following gap spacings between target sites: 0, 2, 4, 7, 10, 14, 18, 23, 28, and 34 base pairs. The pairs were tested against a reporter gene in an SSA assay as well as in a mammalian cell against the endogenous locus. The C-caps are illustrated below where the illustration starts at the last full repeat of a TALE DNA binding domain and shows the points towards the C terminus.

```
                                                                   (SEQ ID NO: 132)
                     C-41    C-35    C-28   C-21 C-16     C-8    C-2
               LTPEQVVAIASHDGGKQALETVQRLLPVLCQAHGLTPEQVVAIASNGGGRPALE  C-1
               |←          full repeat           →||←   half repeat  →|

C+5   C+11  C+17 C+22  C+28  C+34 C+39    C+47       C+55     C+63      C+72
        SIVAQLSRPDPALAALTNDHLVALACLGGRPALDAVKKGLPHAPALIKRTNRRIPERTSHRVADHAQVVRVLGFFQC

C+79  C+87      C+95          C+109          C+123            C+138          C+153
       HSHPAQAFDDAMTQFGMSRHGLLQLFRRVGVTELEARSGTLPPASQRWDRILQASGMKRAKPSPTSTQTPDQASLHA

C+183                         C+213             C+231
               FADSLERDLDAPSPTHEGDQRRASSRKRSRSDRAVTGPSAQQSFEVRAPEQRDALHLPLSWRVKRPRTSIGGGLPDP

GTPTAADLAASSTVMREQDEDPFAGAADDFPAFNEEELAWLMELLPQ  C+278
```

The target sites for the experiment are shown below, illustrating the pair with a 7 bp gap spacing. Note that the -C−16, C−21, C−28, C−35, and C−41 C-cap constructs remove the RVD in the half repeat for each TALEN in the pair and such constructs effectively have a 9 bp gap spacing for the same target DNA sequence. Target sites for all the other gap spacings tested were constructed by either removing base pairs between the targets or by inserting additional base pairs, depending on the gap spacing to be tested(SEQ ID NOS 445-450, respectively, in order of appearance):

```
Left TALEN binding site-gap--Right TALEN binding site
L538        TCATTACACCTGCAGCT L543             ACACCTGCAGCTCTCAT
AAAAAGAAGGTCTTCATTACACCTGCAGCTCTCATTTTCCATACAGTCAGTATCAATTCTGGAAGAATTTCCAGACA
TTTTTCTTCCAGAAGTAATGTGGACGTCGAGAGTAAAAGGTATGTCAGTCATAGTTAAGACCTTCTTAAAGGTCTGT
                                          TGTCAGTCATAGT                R551
                                             TCATAGTTAAGACCTTC          R557
```

The genes encoding the TALEN proteins were assembled as described in Examples 11 and 12 and evaluated by Cel-1 assays. The data are presented below in Table 26A. As shown, the TALE-proteins as described herein can tolerate C-terminal truncations relative to full-length TALE-proteins, including truncations extending into a half repeat and TALE repeat domain itself without complete loss of functionality against an endogenous locus.

In addition, the C-terminal truncations were tested against a reporter gene in the DLSSA assay as described below in Example 19. In these experiments, four pairs of CCR5-specific TALENs were used in the reporter system where the target site of these pairs was built into the DLSSA reporter plasmids. The binding sites of the four TALENs are shown above and the TALENs were used as four pairs, L543+R551 (Pair 1), L538+R551 (Pair 2), L543+R557 (Pair 3) L538+R557 (Pair 4). Gap spacings were varied by insertion or deletion of nucleotides between the binding sites for the pairs. The data are presented below in Table 26 B-E where numeric value indicates the relative fluorescence detected by the DLSSA assay and thus the degree of cleavage. All samples were normalized to a control TALEN pair whose binding site is also present on the DLSSA insert (positive control). Negative control is the assay performed in the absence of TALENs. The reporter #4 has the exact DNA binding sequence and the same gap sequences as the endogenous sequence, and thus can be compared with the Cel-I data at the endogenous locus. The DLSSA data of the four TALEN pairs from reporter #4 is shown in Table 26A. These data illustrate a general correlation between the results found with a reporter system and those observed on an endogenous target are close and thus the reporter system is useful as a screening tool for candidate nucleases to test in any endogenous assay. This is a useful tool when working in systems with precious model cells or when the intended target cell type is either not available or difficult to be used for screening purpose. This is also useful tool to develop and to optimize TALEN technology platform when the target sequences are not available in endogenous genome. Active nucleases can be identified by DLSSA and then ported into the endogenous system for final evaluation.

TABLE 26A

Effect of C-cap on TALEN activity in mammalian cells

| | L543-R551 (7 bp gap) | | | L538-R551 (12 bp gap) | | | L543-R557 (13 bp gap) | | | L538-R557 (18 bp gap) | | |
|---|---|---|---|---|---|---|---|---|---|---|---|---|
| | Cel1 | | | Cel1 | | | Cel1 | | | Cel1 | | |
| C-Cap | 37 C. | 30 C. | DLSSA | 37 C. | 30 C. | DLSSA | 37 C. | 30 C. | DLSSA | 37 C. | 30 C. | DLSSA |
| C − 41 | 0 | 14 | 0.60 | 0 | 0 | 0.12 | 0 | 0 | 0.15 | 0 | 14 | 0.90 |
| C − 35 | 1 | 41 | 0.79 | 0 | 0 | 0.24 | 0 | 2 | 0.28 | 3 | 47 | 1.24 |
| C − 28 | 0 | 4 | 0.23 | 0 | 0 | 0.11 | 0 | 2 | 0.26 | 4 | 65 | 1.47 |
| C − 21 | 0 | 0 | 0.10 | 0 | 0 | 0.19 | 0 | 1 | 0.21 | 3 | 46 | 1.13 |
| C − 16 | 0 | 0 | 0.06 | 0 | 0 | 0.25 | 0 | 2 | 0.27 | 4 | 37 | 1.29 |
| C − 8 | 0 | 0 | 0.02 | 0 | 0 | 0.11 | 0 | 0 | 0.14 | 0 | 8 | 0.99 |
| C − 2 | 0 | 0 | 0.03 | 1 | 29 | 0.74 | 2 | 15 | 1.14 | 20 | 47 | 1.01 |
| C − 1 | 0 | 0 | 0.13 | 18 | 54 | 0.82 | 1 | 21 | 1.29 | 10 | 46 | 1.10 |
| C + 5 | 0 | 0 | 0.08 | 42 | 75 | 0.92 | 1 | 13 | 1.00 | 0 | NA | 0.12 |
| C + 11 | 0 | 0 | 0.05 | 69 | 68 | 1.02 | 34 | 66 | 1.49 | 5 | 5 | 0.35 |
| C + 17 | 0 | 0 | 0.05 | 73 | 81 | 1.03 | 36 | 59 | 1.33 | 5 | 13 | 0.88 |
| C + 22 | 0 | 0 | 0.05 | 36 | 74 | 1.08 | 11 | 46 | 1.09 | 2 | 11 | 0.93 |
| C + 28 | 0 | 0 | 0.01 | 21 | 67 | 0.65 | 9 | 46 | 1.38 | 1 | 10 | 0.57 |
| C + 34 | 0 | 0 | 0.06 | 40 | 71 | 1.15 | 18 | 61 | 1.14 | 3 | 18 | 1.45 |
| C + 39 | 0 | 0 | 0.00 | 15 | 32 | 0.34 | 4 | 14 | 0.79 | 21 | 55 | 0.85 |
| C + 47 | 0 | 0 | 0.02 | 0 | 3 | 1.31 | 0 | 4 | 1.23 | 8 | 41 | 1.55 |
| C + 55 | 0 | 0 | 0.05 | 31 | 71 | 0.19 | 23 | 69 | 1.64 | 7 | 40 | 1.17 |
| C + 63 | 0 | 0 | 0.07 | 4 | 14 | 0.83 | 11 | 57 | 1.10 | 22 | 64 | 0.62 |
| C + 72 | 0 | 0 | 0.03 | 11 | 18 | 0.21 | 28 | 61 | 1.50 | 15 | 54 | 0.82 |
| C + 79 | 0 | 0 | 0.03 | 1 | 5 | 0.19 | 4 | 42 | 1.24 | 7 | 43 | 0.86 |
| C + 87 | 0 | 0 | 0.04 | 0 | 0 | 0.12 | 1 | 12 | 0.91 | 4 | 28 | 0.78 |
| C + 95 | 0 | 0 | 0.04 | 0 | 0 | 0.12 | 1 | 8 | 0.69 | 0 | NA | 0.92 |
| C + 109 | 0 | 0 | 0.04 | 0 | 0 | 0.12 | 0 | 1 | 0.29 | 1 | 13 | 0.83 |
| C + 123 | 0 | 0 | 0.04 | 0 | 0 | 0.13 | 0 | 3 | 0.37 | 1 | 24 | 0.97 |
| C + 138 | 0 | 0 | 0.04 | 0 | 0 | 0.09 | 0 | 9 | 0.73 | 3 | 35 | 0.56 |
| C + 153 | 0 | 0 | 0.06 | 0 | 0 | 0.07 | 0 | 0 | 0.58 | 0 | 5 | 0.38 |
| C + 183 | 0 | 0 | 0.07 | 0 | 0 | 0.07 | 0 | 0 | 0.26 | 0 | 2 | 0.35 |
| C + 213 | 0 | 0 | 0.02 | 0 | 0 | 0.05 | 0 | 0 | 0.18 | 0 | 0 | 0.15 |
| C + 231 | 0 | 0 | 0.04 | 0 | 0 | 0.03 | 0 | 0 | 0.14 | 0 | 1 | 0.08 |
| C + 278 | 0 | 0 | 0.05 | 0 | 0 | 0.03 | 0 | 0 | 0.12 | 0 | 0 | 0.72 |

Note:
numbers are the percent NHEJ activity as measured by the Cel-I assay.

TABLE 26B

DLSSA assay with L543-R551 TALEN pair

| | Reporter | | | | | | | | | |
|---|---|---|---|---|---|---|---|---|---|---|
| | R1 | R2 | R3 | R4 | R5 | R6 | R7 | R8 | R9 | R10 |
| | | | | | | Gap (bp) | | | | |
| C-cap | 0 | 2 | 4 | 7 | 10 | 14 | 18 | 23 | 28 | 34 |
| C − 41 | 0.03 | 0.05 | 0.05 | 0.60 | 0.23 | 0.07 | 0.04 | 0.05 | 0.07 | 0.03 |
| C − 35 | 0.02 | 0.06 | 0.10 | 0.79 | 0.93 | 0.07 | 0.33 | 0.04 | 0.06 | 0.00 |
| C − 28 | 0.02 | 0.05 | 0.03 | 0.23 | 0.11 | 0.05 | 0.01 | 0.02 | 0.04 | 0.02 |
| C − 21 | 0.02 | 0.04 | 0.01 | 0.10 | 0.44 | 0.06 | 0.17 | 0.04 | 0.04 | 0.03 |
| C − 16 | 0.01 | 0.05 | 0.03 | 0.06 | 0.37 | 0.05 | 0.15 | 0.02 | 0.05 | 0.02 |
| C − 8 | 0.03 | 0.05 | 0.04 | 0.02 | 0.19 | 0.47 | 0.00 | 0.01 | 0.04 | 0.02 |
| C − 2 | 0.01 | 0.03 | 0.00 | 0.03 | 1.10 | 0.17 | 0.46 | 0.05 | 0.15 | 0.03 |
| C − 1 | 0.04 | 0.04 | 0.05 | 0.13 | 1.23 | 0.27 | 0.84 | 0.14 | 0.16 | 0.04 |
| C + 5 | 0.04 | 0.07 | 0.06 | 0.08 | 1.26 | 0.08 | 0.03 | 0.12 | 0.10 | 0.08 |
| C + 11 | 0.04 | 0.05 | 0.03 | 0.05 | 1.35 | 1.00 | 0.03 | 0.91 | 0.09 | 0.14 |
| C + 17 | 0.06 | 0.07 | 0.04 | 0.05 | 1.39 | 1.36 | 0.14 | 1.30 | 0.09 | 0.16 |
| C + 22 | 0.06 | 0.03 | 0.04 | 0.05 | 1.06 | 1.09 | 0.23 | 1.07 | 0.12 | 0.15 |
| C + 28 | 0.01 | 0.03 | 0.03 | 0.01 | 0.71 | 0.22 | 0.16 | 0.43 | 0.18 | 0.04 |
| C + 34 | 0.05 | 0.05 | 0.04 | 0.06 | 0.64 | 1.33 | 0.27 | 1.13 | 0.21 | 0.24 |
| C + 39 | 0.00 | 0.02 | 0.02 | 0.00 | 0.06 | 0.32 | 0.77 | 1.02 | 0.53 | 0.04 |
| C + 47 | 0.04 | 0.04 | 0.03 | 0.02 | 0.21 | 1.29 | 0.43 | 1.46 | 0.06 | 0.15 |
| C + 55 | 0.04 | 0.04 | 0.03 | 0.05 | 0.61 | 1.09 | 0.44 | 1.29 | 0.25 | 0.13 |
| C + 63 | −0.01 | −0.01 | 0.01 | 0.07 | 0.15 | 0.75 | 0.83 | 0.87 | 0.69 | 0.15 |
| C + 72 | 0.00 | 0.01 | 0.01 | 0.03 | 0.06 | 0.88 | 0.78 | 1.06 | 0.55 | 0.26 |
| C + 79 | 0.02 | 0.02 | 0.02 | 0.03 | 0.13 | 0.96 | 0.93 | 1.18 | 0.75 | 0.27 |
| C + 87 | 0.03 | 0.03 | 0.02 | 0.04 | 0.11 | 0.87 | 0.73 | 0.87 | 0.43 | 0.21 |
| C + 95 | 0.05 | 0.04 | 0.03 | 0.04 | 0.10 | 0.89 | 0.83 | 0.94 | 0.47 | 0.27 |
| C + 109 | 0.05 | 0.03 | 0.03 | 0.04 | 0.09 | 0.48 | 0.62 | 0.47 | 0.39 | 0.30 |
| C + 123 | 0.04 | 0.04 | 0.03 | 0.04 | 0.06 | 0.68 | 0.65 | 0.49 | 0.46 | 0.26 |
| C + 138 | 0.02 | 0.03 | 0.02 | 0.04 | 0.08 | 0.62 | 1.13 | 0.95 | 1.38 | 0.56 |
| C + 153 | 0.04 | 0.04 | 0.03 | 0.06 | 0.10 | 0.54 | 0.86 | 0.81 | 1.09 | 0.40 |
| C + 183 | 0.05 | 0.03 | 0.01 | 0.07 | 0.15 | 0.24 | 0.96 | 0.51 | 0.90 | 0.43 |
| C + 213 | 0.02 | 0.02 | 0.01 | 0.02 | 0.06 | 0.15 | 0.34 | 0.24 | 0.34 | 0.18 |
| C + 231 | 0.04 | 0.03 | 0.02 | 0.04 | 0.05 | 0.10 | 0.27 | 0.21 | 0.19 | 0.12 |
| C + 278 | 0.07 | 0.05 | 0.03 | 0.05 | 0.13 | 0.12 | 0.67 | 0.17 | 0.69 | 0.07 |

TABLE 26C

DLSSA assay with L538-R551 TALEN pair

| | Reporter | | | | | | | | | |
|---|---|---|---|---|---|---|---|---|---|---|
| | R1 | R2 | R3 | R4 | R5 | R6 | R7 | R8 | R9 | R10 |
| | | | | | | Gap (bp) | | | | |
| C-cap | 5 | 7 | 9 | 12 | 15 | 19 | 23 | 28 | 33 | 39 |
| C − 41 | 0.22 | 0.80 | 0.60 | 0.12 | 0.15 | 0.11 | 0.06 | 0.07 | 0.07 | 0.04 |
| C − 35 | 0.26 | 0.99 | 0.85 | 0.24 | 0.30 | 0.27 | 0.13 | 0.08 | 0.04 | 0.07 |
| C − 28 | 0.60 | 0.60 | 0.13 | 0.11 | 0.08 | 0.05 | 0.06 | 0.03 | 0.04 | 0.03 |
| C − 21 | 0.10 | 0.63 | 0.71 | 0.19 | 0.26 | 0.23 | 0.08 | 0.05 | 0.04 | 0.06 |
| C − 16 | 0.08 | 0.55 | 0.83 | 0.25 | 0.35 | 0.28 | 0.09 | 0.06 | 0.03 | 0.06 |
| C − 8 | 0.04 | 0.06 | 0.17 | 0.11 | 0.07 | 0.05 | 0.02 | 0.01 | 0.02 | 0.06 |
| C − 2 | 0.35 | 0.19 | 0.80 | 0.74 | 0.35 | 0.71 | 0.18 | 0.13 | 0.10 | 0.01 |
| C − 1 | 0.42 | 0.38 | 0.80 | 0.82 | 0.32 | 0.88 | 0.46 | 0.20 | 0.25 | 0.05 |
| C + 5 | 0.27 | 0.18 | 0.15 | 0.92 | 0.09 | 0.13 | 0.37 | 0.07 | 0.19 | 0.02 |
| C + 11 | 0.28 | 0.07 | 0.18 | 1.02 | 0.35 | 0.27 | 1.14 | 0.11 | 0.31 | 0.04 |
| C + 17 | 0.21 | 0.09 | 0.26 | 1.03 | 0.79 | 0.38 | 1.15 | 0.13 | 0.43 | 0.06 |
| C + 22 | 0.14 | 0.06 | 0.13 | 1.08 | 0.87 | 0.34 | 1.07 | 0.14 | 0.39 | 0.07 |
| C + 28 | 0.20 | 0.04 | 0.12 | 0.65 | 0.51 | 0.29 | 0.64 | 0.08 | 0.16 | 0.00 |
| C + 34 | 0.08 | 0.06 | 0.14 | 1.15 | 0.96 | 0.75 | 1.08 | 0.28 | 0.53 | 0.11 |
| C + 39 | 0.11 | −0.02 | 0.02 | 0.34 | 0.65 | 0.40 | 1.03 | 0.72 | 0.33 | 0.05 |
| C + 47 | 0.11 | 0.13 | 0.30 | 1.31 | 1.17 | 0.75 | 1.33 | 0.31 | 0.51 | 0.13 |
| C + 55 | 0.23 | 0.08 | 0.14 | 0.19 | 0.53 | 0.77 | 0.91 | 0.76 | 0.54 | 0.09 |
| C + 63 | 0.33 | 0.07 | 0.18 | 0.83 | 0.71 | 0.90 | 1.19 | 0.26 | 0.37 | 0.02 |
| C + 72 | 0.26 | −0.01 | 0.03 | 0.21 | 0.50 | 0.55 | 0.78 | 0.64 | 0.32 | 0.17 |
| C + 79 | 0.25 | 0.01 | 0.04 | 0.19 | 0.59 | 0.53 | 0.95 | 0.68 | 0.64 | 0.24 |
| C + 87 | 0.15 | 0.00 | 0.04 | 0.12 | 0.64 | 0.36 | 0.75 | 0.51 | 0.46 | 0.23 |
| C + 95 | 0.10 | 0.01 | 0.06 | 0.12 | 0.74 | 0.40 | 0.71 | 0.46 | 0.56 | 0.24 |
| C + 109 | 0.08 | 0.03 | 0.05 | 0.12 | 0.67 | 0.31 | 0.50 | 0.34 | 0.44 | 0.33 |
| C + 123 | 0.06 | 0.06 | 0.07 | 0.13 | 0.84 | 0.45 | 0.61 | 0.44 | 0.46 | 0.33 |
| C + 138 | 0.48 | 0.01 | 0.03 | 0.09 | 0.67 | 1.02 | 1.15 | 1.13 | 0.96 | 0.30 |
| C + 153 | 0.35 | 0.01 | 0.03 | 0.07 | 0.63 | 0.78 | 1.09 | 0.91 | 0.83 | 0.30 |

TABLE 26C-continued

DLSSA assay with L538-R551 TALEN pair

| | Reporter | | | | | | | | | |
|---|---|---|---|---|---|---|---|---|---|---|
| | R1 | R2 | R3 | R4 | R5 | R6 | R7 | R8 | R9 | R10 |
| | | | | | | Gap (bp) | | | | |
| C-cap | 5 | 7 | 9 | 12 | 15 | 19 | 23 | 28 | 33 | 39 |
| C + 183 | 0.45 | 0.05 | 0.06 | 0.07 | 0.64 | 0.62 | 1.01 | 0.99 | 0.95 | 0.38 |
| C + 213 | 0.24 | 0.02 | 0.02 | 0.05 | 0.58 | 0.35 | 0.66 | 0.62 | 0.62 | 0.28 |
| C + 231 | 0.12 | 0.01 | 0.02 | 0.03 | 0.53 | 0.12 | 0.29 | 0.25 | 0.32 | 0.12 |
| C + 278 | 0.07 | 0.03 | 0.03 | 0.03 | 0.49 | 0.19 | 0.17 | 0.51 | 0.15 | 0.07 |

TABLE 26D

DLSSA assay with L543-R557 TALEN pair

| | Reporter | | | | | | | | | |
|---|---|---|---|---|---|---|---|---|---|---|
| | R1 | R2 | R3 | R4 | R5 | R6 | R7 | R8 | R9 | R10 |
| | | | | | | Gap (bp) | | | | |
| C-cap | 6 | 8 | 10 | 13 | 16 | 20 | 24 | 29 | 34 | 40 |
| C − 41 | 0.62 | 0.85 | 0.32 | 0.15 | 0.26 | 0.08 | −0.02 | 0.01 | 0.03 | 0.15 |
| C − 35 | 0.64 | 0.99 | 0.93 | 0.28 | 0.71 | 0.24 | 0.03 | 0.07 | 0.03 | 0.55 |
| C − 28 | 0.21 | 0.77 | 1.27 | 0.26 | 0.34 | 0.38 | −0.01 | 0.04 | 0.04 | 0.31 |
| C − 21 | 0.07 | 0.59 | 0.76 | 0.21 | 0.31 | 0.26 | 0.02 | 0.07 | 0.07 | 0.21 |
| C − 16 | 0.07 | 1.11 | 0.83 | 0.27 | 0.38 | 0.32 | 0.07 | 0.11 | 0.13 | 0.15 |
| C − 8 | 0.10 | 1.51 | 1.29 | 0.14 | 0.16 | 0.30 | 0.00 | 0.08 | 0.13 | 0.09 |
| C − 2 | 0.36 | 1.62 | 1.72 | 1.14 | 1.71 | 0.80 | 0.13 | 0.14 | 0.10 | 0.25 |
| C − 1 | 0.33 | 1.65 | 1.43 | 1.29 | 1.39 | 1.00 | 0.15 | 0.16 | 0.10 | 0.23 |
| C + 5 | 0.15 | 0.11 | 1.11 | 1.00 | 0.36 | 0.64 | 0.03 | 0.00 | 0.19 | 0.15 |
| C + 11 | 0.11 | 0.10 | 1.02 | 1.49 | 0.75 | 0.75 | 0.29 | 0.04 | 0.31 | 0.10 |
| C + 17 | 0.10 | 0.00 | 1.05 | 1.33 | 0.84 | 0.86 | 0.59 | 0.08 | 0.40 | 0.08 |
| C + 22 | 0.08 | −0.01 | 0.82 | 1.09 | 0.98 | 0.56 | 0.42 | 0.10 | 0.28 | 0.08 |
| C + 28 | 0.14 | 0.08 | 1.14 | 1.38 | 1.65 | 0.64 | 0.37 | 0.18 | 0.23 | 0.22 |
| C + 34 | 0.06 | 0.04 | 0.78 | 1.14 | 1.09 | 0.78 | 0.55 | 0.18 | 0.53 | 0.10 |
| C + 39 | 0.16 | 0.04 | 0.06 | 0.79 | 1.86 | 0.79 | 0.30 | 0.40 | 0.05 | 0.25 |
| C + 47 | 0.09 | 0.08 | 0.47 | 1.23 | 1.30 | 0.84 | 0.73 | 0.31 | 0.55 | 0.14 |
| C + 55 | 0.26 | 0.10 | 0.48 | 1.64 | 2.50 | 1.11 | 1.03 | 0.25 | 0.65 | 0.27 |
| C + 63 | 0.19 | 0.04 | 0.14 | 1.10 | 2.47 | 0.85 | 0.87 | 0.67 | 0.44 | 0.69 |
| C + 72 | 0.21 | 0.34 | 0.22 | 1.50 | 2.19 | 1.00 | 0.84 | 0.49 | 0.51 | 0.77 |
| C + 79 | 0.19 | 0.05 | 0.11 | 1.24 | 1.49 | 0.71 | 0.53 | 0.28 | 0.35 | 0.61 |
| C + 87 | 0.11 | 0.03 | 0.08 | 0.91 | 1.25 | 0.46 | 0.33 | 0.21 | 0.27 | 0.32 |
| C + 95 | 0.08 | 0.02 | 0.07 | 0.69 | 0.99 | 0.51 | 0.43 | 0.29 | 0.35 | 0.30 |
| C + 109 | 0.08 | 0.11 | 0.14 | 0.29 | 0.85 | 0.31 | 0.27 | 0.31 | 0.39 | 0.30 |
| C + 123 | 0.08 | 0.08 | 0.08 | 0.37 | 0.94 | 0.36 | 0.37 | 0.42 | 0.51 | 0.28 |
| C + 138 | 0.29 | 0.17 | 0.19 | 0.73 | 3.13 | 0.56 | 1.19 | 0.53 | 0.63 | 1.17 |
| C + 153 | 0.24 | 0.16 | 0.11 | 0.58 | 2.16 | 0.57 | 1.09 | 0.46 | 0.52 | 0.98 |
| C + 183 | 0.28 | 0.19 | 0.15 | 0.26 | 2.32 | 0.38 | 0.78 | 0.26 | 0.44 | 0.88 |
| C + 213 | 0.22 | 0.10 | 0.05 | 0.18 | 1.32 | 0.20 | 0.32 | 0.10 | 0.24 | 0.40 |
| C + 231 | 0.13 | 0.11 | 0.04 | 0.14 | 0.92 | 0.09 | 0.17 | 0.04 | 0.11 | 0.12 |
| C + 278 | 0.08 | 0.11 | 0.04 | 0.12 | 0.76 | 0.37 | 0.18 | 0.42 | 0.10 | 0.14 |

TABLE 26E

DLSSA assay with L538-R557 TALEN pair

| | Reporter | | | | | | | | | |
|---|---|---|---|---|---|---|---|---|---|---|
| | R1 | R2 | R3 | R4 | R5 | R6 | R7 | R8 | R9 | R10 |
| | | | | | | Gap (bp) | | | | |
| C-cap | 11 | 13 | 15 | 18 | 21 | 25 | 29 | 34 | 39 | 45 |
| C − 41 | 0.45 | 0.28 | 1.26 | 0.90 | 0.07 | 0.34 | 0.17 | 0.02 | 0.17 | 0.09 |
| C − 35 | 0.94 | 0.34 | 1.82 | 1.24 | 0.27 | 0.52 | 0.32 | 0.05 | 0.26 | 0.16 |
| C − 28 | 1.21 | 0.71 | 2.99 | 1.47 | 0.38 | 0.11 | 0.37 | 0.02 | 0.09 | 0.10 |
| C − 21 | 1.03 | 0.03 | 1.03 | 1.13 | 0.01 | 0.03 | 0.39 | 0.03 | 0.16 | 0.08 |
| C − 16 | 0.77 | 0.71 | 1.30 | 1.29 | 0.43 | 0.16 | 0.48 | 0.07 | 0.14 | 0.15 |
| C − 8 | 1.01 | 1.00 | 0.61 | 0.99 | 0.46 | 0.02 | 0.20 | 0.02 | 0.04 | 0.05 |
| C − 2 | 0.94 | 0.78 | 1.43 | 1.01 | 0.75 | 0.39 | 0.29 | 0.06 | 0.17 | 0.06 |
| C − 1 | 1.20 | 0.88 | 1.81 | 1.10 | 1.04 | 0.76 | 0.41 | 0.24 | 0.18 | 0.22 |

TABLE 26E-continued

DLSSA assay with L538-R557 TALEN pair

| | Reporter | | | | | | | | | |
|---|---|---|---|---|---|---|---|---|---|---|
| | R1 | R2 | R3 | R4 | R5 | R6 | R7 | R8 | R9 | R10 |
| | | | | | | Gap (bp) | | | | |
| C-cap | 11 | 13 | 15 | 18 | 21 | 25 | 29 | 34 | 39 | 45 |
| C + 5 | 1.29 | 0.75 | 0.38 | 0.12 | 0.65 | 0.11 | 0.02 | 0.40 | 0.06 | 0.17 |
| C + 11 | 1.39 | 1.00 | 0.97 | 0.35 | 0.90 | 0.46 | 0.08 | 0.53 | 0.08 | 0.24 |
| C + 17 | 1.34 | 0.85 | 1.95 | 0.88 | 1.04 | 0.94 | 0.20 | 0.61 | 0.06 | 0.29 |
| C + 22 | 1.58 | 1.32 | 1.70 | 0.93 | 1.03 | 0.85 | 0.23 | 0.42 | 0.07 | 0.22 |
| C + 28 | 0.78 | 0.63 | 1.44 | 0.57 | 0.52 | 0.61 | 0.08 | 0.15 | 0.15 | 0.09 |
| C + 34 | 1.35 | 1.58 | 2.05 | 1.45 | 1.27 | 0.92 | 0.48 | 0.47 | 0.16 | 0.20 |
| C + 39 | 0.01 | 0.49 | 1.49 | 0.85 | 0.61 | 0.25 | 0.47 | 0.03 | 0.12 | 0.05 |
| C + 47 | 1.24 | 1.10 | 1.71 | 1.55 | 1.45 | 1.07 | 0.54 | 0.52 | 0.11 | 0.31 |
| C + 55 | 1.14 | 1.48 | 1.96 | 1.17 | 1.05 | 1.42 | 0.36 | 0.55 | 0.36 | 0.42 |
| C + 63 | 0.03 | 0.42 | 1.11 | 0.62 | 0.67 | 0.76 | 0.41 | 0.14 | 0.35 | 0.07 |
| C + 72 | 0.09 | 0.79 | 1.43 | 0.82 | 0.75 | 1.23 | 0.52 | 0.27 | 0.43 | 0.17 |
| C + 79 | 0.07 | 0.90 | 1.26 | 0.86 | 0.90 | 1.18 | 0.50 | 0.19 | 0.38 | 0.20 |
| C + 87 | 0.06 | 0.89 | 1.20 | 0.78 | 0.89 | 0.92 | 0.40 | 0.22 | 0.25 | 0.15 |
| C + 95 | 0.05 | 0.91 | 2.72 | 0.92 | 0.93 | 0.77 | 0.41 | 0.23 | 0.22 | 0.19 |
| C + 109 | 0.08 | 0.57 | 0.90 | 0.83 | 0.90 | 0.66 | 0.62 | 0.37 | 0.33 | 0.18 |
| C + 123 | 0.05 | 0.93 | 0.88 | 0.97 | 0.99 | 0.58 | 0.57 | 0.35 | 0.20 | 0.22 |
| C + 138 | 0.05 | 0.42 | 1.19 | 0.56 | 0.57 | 1.03 | 0.22 | 0.26 | 0.77 | 0.23 |
| C + 153 | 0.04 | 0.63 | 0.78 | 0.38 | 0.61 | 0.84 | 0.19 | 0.23 | 0.57 | 0.25 |
| C + 183 | 0.04 | 0.15 | 0.68 | 0.35 | 0.39 | 0.78 | 0.14 | 0.25 | 0.60 | 0.29 |
| C + 213 | 0.03 | 0.13 | 0.37 | 0.15 | 0.29 | 0.42 | 0.11 | 0.15 | 0.32 | 0.24 |
| C + 231 | 0.00 | 0.14 | 0.29 | 0.08 | 0.19 | 0.24 | 0.03 | 0.06 | 0.10 | 0.10 |
| C + 278 | 0.03 | 0.18 | 0.55 | 0.72 | 0.71 | 0.37 | 0.90 | 0.08 | 0.21 | 0.08 |

Thus, the Cel-I and DLSSA results indicate that these proteins have substantial and robust activity when the appropriate C-cap is used and an N-cap is present. Further, gap spacings may play a role in the maximum activity observed with smaller gap spacings being active with a smaller subset of C-terminal truncations as compared to larger gap spacings. We also note that the relative DLSSA activity does not appear to be linearly related to the endogenous activity for the same TALENs obtained at the same temperature (37 degrees Celsius). The reporter results yield a significantly higher relative activity for constructs with C+153, C+183, C+213, C+231, and C+278 C-caps than observed at the native endogenous locus of human cells. Thus activity in reporter systems, even reporter systems in mammalian cells, does not necessarily predict the activity at the native endogenous in mammalian cells.

Example 15

Novel (Atypical) RVDs

Alternative (atypical) RVDs were explored to determine if other amino acids at the positions that determine DNA binding specificity could be altered. A TALE binding domain was constructed whose binding activity was shown by SELEX and ELISA to be sensitive to a mismatch at the middle position. This protein bound the sequence 5'-TTGACAATCCT-3'(SEQ ID NO:178) and displayed little binding activity against the sequences 5'-TTGACCATCCT-3' (SEQ ID NO:179), 5'-TTGACGATCCT-3' (SEQ ID NO:180), or 5'-TTGACTATCCT-3' (SEQ ID NO:181) (ELISA data shown in FIG. 27). These targets are referred to as the CXA targets denoting the middle triplet nucleic acid, where X is either A, C, T or G.

This TALE backbone was then used to characterize the DNA-binding specificity of alternative RVDs (amino acids 12 and 13) for the TALE repeat that targets the base at the 6$^{th}$ position. The two codons that encode this RVD were randomized and clones were screened by sequencing to ensure that the complete repeat units were present. Correct clones were then analyzed by a DNA-binding ELISA against four versions of the target sequence wherein each sequence had either an A, C, T or G at the position the novel (i.e., atypical) RVD would interact with (i.e. TTGACCAATCCT (SEQ ID NO:178), TTGACCATCCT (SEQ ID NO:182), TTGACTATCCT (SEQ ID NO:183) or TTGACGATCCT (SEQ ID NO:184)). Results from these studies are shown below in Table 27A and demonstrate that this assay identified that the RVD VG can specifically interact with T, RG can interact with T, TA can interact with T and AA can interact with A, C and T.

TABLE 27A

Exemplary novel RVDs

| RVD | Note | Target (ELISA units) | | | |
|---|---|---|---|---|---|
| | | CAA | CCA | CGA | CTA |
| AE | | 9 | 10 | 9 | 11 |
| GR | | 10 | 9 | 14 | 29 |
| TR | | 17 | 47 | 12 | 308 |
| PR | | 8 | 7 | 8 | 13 |
| LH | | 9 | 8 | 9 | 12 |
| VG | | 34 | 16 | 14 | 596 |
| RE | | 23 | 24 | 9 | 24 |
| RG | | 487 | 314 | 169 | 1240 |
| RC | | 12 | 9 | 7 | 8 |
| TA | | 89 | 125 | 16 | 755 |
| AA | | 433 | 447 | 84 | 750 |
| QR | | 11 | 8 | 10 | 13 |
| LR | | 11 | 9 | 8 | 12 |
| SR | | 13 | 11 | 23 | 27 |
| GE | | 9 | 9 | ND | 13 |
| VR | | 33 | 14 | ND | 26 |

TABLE 27A-continued

Exemplary novel RVDs

| RVD | Note | Target (ELISA units) | | | |
|---|---|---|---|---|---|
| | | CAA | CCA | CGA | CTA |
| NI | CAA Binder Control | 1105 | 45 | 15 | 13 |
| NN | CGA Binder Control | 1305 | 10 | 1730 | 13 |
| | negative Control | | | | 7 |

Following these initial studies, an analysis was done with all potential RVD combinations and several were identified with high activity and specificity. In addition, RVDs were identified that bound equally well to all bases tested. The data are presented in numeric format below in Table 27B and also in FIG. 28. In the data shown below, all data was background corrected by subtracting the background ELISA signal and then normalized to the average value of NI with the CAA site, HD with the CCA site, NN with the CGA site, and NG with the CTA site.

TABLE 27B

Novel RVDs

| RVD | CAA | CCA | CGA | CTA | RVD | CAA | CCA | CGA | CTA |
|---|---|---|---|---|---|---|---|---|---|
| AA | 0.34 | 0.35 | 0.06 | 0.61 | AE | 0.00 | 0.00 | 0.00 | 0.00 |
| CA | 0.18 | 0.22 | 0.02 | 0.89 | CE | 0.01 | 0.05 | 0.00 | 0.04 |
| DA | 0.12 | 0.22 | 0.02 | 0.55 | DE | 0.01 | 0.01 | 0.00 | 0.01 |
| EA | 0.26 | 0.58 | 0.08 | 1.20 | EE | 0.01 | 0.04 | 0.00 | 0.03 |
| FA | 0.22 | 0.26 | 0.03 | 1.25 | FE | 0.01 | 0.02 | 0.00 | 0.05 |
| GA | 0.07 | 0.04 | 0.01 | 0.53 | GE | 0.00 | 0.00 | 0.00 | 0.00 |
| HA | 0.46 | 0.53 | 0.24 | 1.54 | HE | 0.03 | 0.04 | 0.00 | 0.08 |
| IA | 0.15 | 0.24 | 0.02 | 1.20 | IE | 0.00 | 0.03 | 0.00 | 0.07 |
| KA | 0.85 | 0.98 | 0.25 | 1.63 | KE | 0.00 | 0.01 | 0.00 | 0.01 |
| LA | 0.02 | 0.02 | 0.00 | 0.51 | LE | 0.00 | 0.01 | 0.00 | 0.03 |
| MA | 0.12 | 0.11 | 0.02 | 0.66 | ME | 0.00 | 0.01 | 0.00 | 0.03 |
| NA | 0.59 | 0.67 | 0.41 | 1.72 | NE | 0.02 | 0.02 | 0.00 | 0.02 |
| PA | 0.00 | 0.00 | 0.00 | 0.04 | PE | 0.00 | 0.00 | 0.00 | 0.03 |
| QA | 0.20 | 0.19 | 0.03 | 1.24 | QE | 0.01 | 0.03 | 0.00 | 0.04 |
| RA | 0.73 | 0.89 | 0.53 | 1.64 | RE | 0.01 | 0.01 | 0.00 | 0.01 |
| SA | 0.42 | 0.44 | 0.06 | 1.05 | SE | 0.00 | 0.01 | 0.00 | 0.01 |
| TA | 0.15 | 0.20 | 0.01 | 0.76 | TE | 0.02 | 0.08 | 0.00 | 0.09 |
| VA | 0.21 | 0.25 | 0.04 | 1.06 | VE | 0.01 | 0.05 | 0.00 | 0.08 |
| WA | 0.49 | 0.35 | 0.05 | 1.40 | WE | 0.00 | 0.01 | 0.00 | 0.03 |
| YA | 0.29 | 0.23 | 0.04 | 1.36 | YE | 0.01 | 0.02 | 0.00 | 0.04 |
| AC | 0.34 | 0.29 | 0.06 | 0.11 | AF | 0.02 | 0.00 | 0.00 | 0.02 |
| CC | 0.20 | 0.32 | 0.08 | 0.19 | CF | 0.01 | 0.00 | 0.00 | 0.02 |
| DC | 0.11 | 0.11 | 0.02 | 0.03 | DF | 0.00 | 0.00 | 0.00 | 0.02 |
| EC | 0.14 | 0.19 | 0.04 | 0.07 | EF | 0.01 | 0.00 | 0.00 | 0.03 |
| FC | 0.08 | 0.14 | 0.03 | 0.05 | FF | 0.00 | 0.00 | 0.00 | 0.03 |
| GC | 0.07 | 0.05 | 0.01 | 0.05 | GF | 0.02 | 0.00 | 0.00 | 0.03 |
| HC | 0.74 | 0.85 | 0.54 | 0.33 | HF | 0.04 | 0.00 | 0.00 | 0.00 |
| IC | 0.07 | 0.20 | 0.02 | 0.15 | IF | 0.00 | 0.00 | 0.00 | 0.02 |
| KC | 0.68 | 0.82 | 0.40 | 0.51 | KF | 0.00 | 0.00 | 0.00 | 0.00 |
| LC | 0.04 | 0.04 | 0.01 | 0.02 | LF | 0.00 | 0.00 | 0.00 | 0.00 |
| MC | 0.05 | 0.06 | 0.01 | 0.04 | MF | 0.00 | 0.00 | 0.00 | 0.01 |
| NC | 0.45 | 0.51 | 0.09 | 0.05 | NF | 0.01 | 0.00 | 0.00 | 0.00 |
| PC | 0.01 | 0.02 | 0.00 | 0.01 | PF | 0.00 | 0.00 | 0.00 | 0.02 |
| QC | 0.14 | 0.17 | 0.03 | 0.09 | QF | 0.01 | 0.00 | 0.00 | 0.02 |
| RC | 0.00 | 0.00 | 0.00 | 0.00 | RF | 0.09 | 0.00 | 0.00 | 0.02 |
| SC | 0.35 | 0.29 | 0.09 | 0.17 | SF | 0.01 | 0.01 | 0.00 | 0.05 |
| TC | 0.09 | 0.12 | 0.03 | 0.17 | TF | 0.01 | 0.00 | 0.00 | 0.02 |
| VC | 0.10 | 0.26 | 0.04 | 0.18 | VF | 0.00 | 0.00 | 0.00 | 0.02 |
| WC | 0.07 | 0.08 | 0.02 | 0.03 | WF | 0.00 | 0.00 | 0.00 | 0.02 |
| YC | 0.12 | 0.14 | 0.05 | 0.05 | YF | 0.00 | 0.00 | 0.00 | 0.02 |
| AD | 0.02 | 0.40 | 0.00 | 0.01 | AG | 0.19 | 0.12 | 0.07 | 0.80 |
| CD | 0.00 | 0.24 | 0.00 | 0.00 | CG | 0.16 | 0.07 | 0.03 | 0.73 |
| DD | 0.00 | 0.13 | 0.00 | 0.00 | DG | 0.02 | 0.01 | 0.00 | 0.13 |
| ED | 0.01 | 0.36 | 0.00 | 0.02 | EG | 0.06 | 0.03 | 0.01 | 0.39 |
| FD | 0.00 | 0.07 | 0.00 | 0.00 | FG | 0.04 | 0.01 | 0.00 | 0.37 |
| GD | 0.00 | 0.04 | 0.02 | 0.01 | GG | 0.49 | 0.35 | 0.25 | 1.52 |

TABLE 27B-continued

Novel RVDs

| RVD | CAA | CCA | CGA | CTA | RVD | CAA | CCA | CGA | CTA |
|---|---|---|---|---|---|---|---|---|---|
| HD | 0.15 | 1.00 | 0.00 | 0.09 | HG | 0.38 | 0.11 | 0.11 | 1.49 |
| ID | 0.00 | 0.08 | 0.00 | 0.01 | IG | 0.04 | 0.02 | 0.01 | 0.68 |
| KD | 0.06 | 0.61 | 0.00 | 0.05 | KG | 0.47 | 0.27 | 0.20 | 1.29 |
| LD | 0.00 | 0.01 | 0.00 | 0.01 | LG | 0.02 | 0.02 | 0.00 | 0.31 |
| MD | 0.00 | 0.04 | 0.00 | 0.00 | MG | 0.20 | 0.14 | 0.05 | 0.95 |
| ND | 0.06 | 0.73 | 0.00 | 0.02 | NG | 0.48 | 0.14 | 0.13 | 1.30 |
| PD | 0.00 | 0.00 | 0.01 | 0.00 | PG | 0.01 | 0.01 | 0.01 | 0.11 |
| QD | 0.01 | 0.24 | 0.00 | 0.00 | QG | 0.21 | 0.11 | 0.05 | 1.09 |
| RD | 0.22 | 0.79 | 0.00 | 0.01 | RG | 0.32 | 0.26 | 0.12 | 0.87 |
| SD | 0.01 | 0.28 | 0.00 | 0.01 | SG | 0.36 | 0.23 | 0.20 | 1.23 |
| TD | 0.01 | 0.10 | 0.00 | 0.06 | TG | 0.24 | 0.14 | 0.06 | 0.96 |
| VD | 0.00 | 0.11 | 0.00 | 0.02 | VG | 0.05 | 0.02 | 0.01 | 0.56 |
| WD | 0.01 | 0.10 | 0.00 | 0.01 | WG | 0.05 | 0.01 | 0.01 | 0.44 |
| YD | 0.01 | 0.28 | 0.00 | 0.01 | YG | 0.12 | 0.02 | 0.01 | 0.79 |
| AP | 0.17 | 0.28 | 0.04 | 0.54 | AS | 0.67 | 0.35 | 0.55 | 0.36 |
| CP | 0.13 | 0.23 | 0.04 | 0.96 | CS | 0.45 | 0.36 | 0.27 | 0.60 |
| DP | 0.06 | 0.10 | 0.01 | 0.25 | DS | 0.24 | 0.17 | 0.17 | 0.09 |
| EP | 0.10 | 0.20 | 0.01 | 0.54 | ES | 0.37 | 0.35 | 0.27 | 0.31 |
| FP | 0.07 | 0.15 | 0.01 | 0.66 | FS | 0.24 | 0.18 | 0.12 | 0.30 |
| GP | 0.04 | 0.07 | 0.01 | 0.11 | GS | 0.50 | 0.11 | 0.27 | 0.16 |
| HP | 0.71 | 0.82 | 0.16 | 0.93 | HS | 0.77 | 0.79 | 0.69 | 0.80 |
| IP | 0.04 | 0.13 | 0.00 | 0.84 | IS | 0.18 | 0.32 | 0.08 | 0.75 |
| KP | 0.55 | 0.77 | 0.13 | 1.37 | KS | 0.95 | 0.78 | 0.74 | 0.81 |
| LP | 0.02 | 0.08 | 0.00 | 0.46 | LS | 0.29 | 0.15 | 0.09 | 0.27 |
| MP | 0.01 | 0.03 | 0.00 | 0.25 | MS | 0.30 | 0.16 | 0.09 | 0.29 |
| NP | 0.07 | 0.17 | 0.06 | 0.81 | NS | 0.51 | 0.26 | 0.71 | 0.54 |
| PP | 0.00 | 0.00 | 0.00 | 0.04 | PS | 0.01 | 0.00 | 0.00 | 0.03 |
| QP | 0.09 | 0.14 | 0.01 | 0.56 | QS | 0.59 | 0.41 | 0.30 | 0.44 |
| RP | 0.77 | 0.76 | 0.15 | 1.40 | RS | 0.64 | 0.59 | 0.63 | 0.52 |
| SP | 0.31 | 0.39 | 0.05 | 1.19 | SS | 0.37 | 0.23 | 0.38 | 0.48 |
| TP | 0.16 | 0.20 | 0.01 | 1.20 | TS | 0.17 | 0.14 | 0.12 | 0.48 |
| VP | 0.07 | 0.13 | 0.01 | 0.87 | VS | 0.29 | 0.29 | 0.15 | 0.67 |
| WP | 0.03 | 0.06 | 0.00 | 0.31 | WS | 0.36 | 0.20 | 0.12 | 0.26 |
| YP | 0.08 | 0.16 | 0.01 | 0.68 | YS | 0.62 | 0.40 | 0.23 | 0.52 |
| AQ | 0.04 | 0.03 | 0.13 | 0.05 | AT | 1.29 | 0.58 | 0.76 | 0.56 |
| CQ | 0.03 | 0.03 | 0.23 | 0.08 | CT | 1.01 | 0.64 | 0.36 | 0.78 |
| DQ | 0.01 | 0.04 | 0.05 | 0.01 | DT | 0.90 | 0.27 | 0.30 | 0.05 |
| EQ | 0.01 | 0.06 | 0.10 | 0.02 | ET | 1.31 | 0.60 | 0.35 | 0.24 |
| FQ | 0.00 | 0.01 | 0.05 | 0.02 | FT | 0.87 | 0.72 | 0.54 | 0.27 |
| GQ | 0.01 | 0.02 | 0.03 | 0.04 | GT | 0.78 | 0.19 | 0.50 | 0.14 |
| HQ | 0.22 | 0.17 | 0.49 | 0.12 | HT | 0.72 | 0.68 | 1.24 | 0.67 |
| IQ | 0.01 | 0.01 | 0.09 | 0.12 | IT | 0.46 | 0.34 | 0.17 | 0.40 |
| KQ | 0.13 | 0.10 | 0.40 | 0.10 | KT | 1.00 | 0.81 | 0.83 | 0.67 |
| LQ | 0.00 | 0.00 | 0.01 | 0.02 | LT | 0.43 | 0.11 | 0.09 | 0.05 |
| MQ | 0.00 | 0.00 | 0.03 | 0.03 | MT | 0.37 | 0.13 | 0.11 | 0.19 |
| NQ | 0.03 | 0.04 | 0.18 | 0.02 | NT | 0.82 | 0.41 | 0.99 | 0.29 |
| PQ | 0.00 | 0.00 | 0.00 | 0.01 | PT | 0.02 | 0.01 | 0.00 | 0.04 |
| QQ | 0.02 | 0.03 | 0.11 | 0.03 | QT | 0.64 | 0.38 | 0.43 | 0.42 |
| RQ | 0.28 | 0.09 | 0.49 | 0.20 | RT | 0.62 | 0.43 | 0.51 | 0.35 |
| SQ | 0.04 | 0.06 | 0.14 | 0.10 | ST | 0.62 | 0.31 | 0.41 | 0.44 |
| TQ | 0.02 | 0.02 | 0.14 | 0.09 | TT | 0.46 | 0.23 | 0.14 | 0.58 |
| VQ | 0.02 | 0.02 | 0.11 | 0.15 | VT | 0.33 | 0.31 | 0.14 | 0.55 |
| WQ | 0.01 | 0.01 | 0.04 | 0.03 | WT | 0.33 | 0.16 | 0.09 | 0.09 |
| YQ | 0.02 | 0.03 | 0.14 | 0.05 | YT | 0.39 | 0.28 | 0.15 | 0.18 |
| AR | 0.00 | 0.00 | 0.00 | 0.01 | AV | 0.21 | 0.12 | 0.10 | 0.10 |
| CR | 0.00 | 0.00 | 0.01 | 0.01 | CV | 0.27 | 0.22 | 0.12 | 0.16 |
| DR | 0.00 | 0.00 | 0.00 | 0.01 | DV | 0.15 | 0.09 | 0.06 | 0.01 |
| ER | 0.00 | 0.00 | 0.01 | 0.01 | EV | 0.18 | 0.14 | 0.06 | 0.02 |
| FR | 0.00 | 0.00 | 0.00 | 0.00 | FV | 0.09 | 0.07 | 0.05 | 0.01 |
| GR | 0.00 | 0.00 | 0.01 | 0.02 | GV | 0.10 | 0.08 | 0.05 | 0.05 |
| HR | 0.00 | 0.00 | 0.03 | 0.02 | HV | 0.56 | 0.49 | 0.25 | 0.02 |
| IR | 0.00 | 0.00 | 0.00 | 0.03 | IV | 0.10 | 0.16 | 0.04 | 0.09 |
| KR | 0.00 | 0.00 | 0.03 | 0.04 | KV | 0.75 | 0.58 | 0.28 | 0.12 |
| LR | 0.00 | 0.00 | 0.00 | 0.00 | LV | 0.06 | 0.04 | 0.02 | 0.01 |
| MR | 0.00 | 0.00 | 0.00 | 0.00 | MV | 0.08 | 0.08 | 0.04 | 0.02 |
| NR | 0.01 | 0.00 | 0.03 | 0.01 | NV | 0.37 | 0.16 | 0.07 | 0.01 |
| PR | 0.00 | 0.00 | 0.00 | 0.00 | PV | 0.00 | 0.00 | 0.00 | 0.01 |
| QR | 0.00 | 0.00 | 0.00 | 0.00 | QV | 0.17 | 0.14 | 0.08 | 0.04 |
| RR | 0.01 | 0.00 | 0.08 | 0.05 | RV | 0.54 | 0.43 | 0.32 | 0.07 |
| SR | 0.00 | 0.00 | 0.01 | 0.02 | SV | 0.29 | 0.17 | 0.14 | 0.14 |
| TR | 0.00 | 0.00 | 0.01 | 0.05 | TV | 0.01 | 0.00 | 0.00 | 0.01 |
| VR | 0.02 | 0.01 | 0.01 | 0.02 | VV | 0.16 | 0.20 | 0.07 | 0.14 |
| WR | 0.00 | 0.00 | 0.00 | 0.01 | WV | 0.10 | 0.08 | 0.02 | 0.01 |
| YR | 0.00 | 0.00 | 0.01 | 0.01 | YV | 0.15 | 0.11 | 0.06 | 0.02 |
| AH | 0.04 | 0.02 | 0.33 | 0.04 | AL | 0.04 | 0.00 | 0.00 | 0.05 |
| CH | 0.02 | 0.02 | 0.04 | 0.12 | CL | 0.07 | 0.00 | 0.00 | 0.03 |

TABLE 27B-continued

Novel RVDs

| RVD | CAA | CCA | CGA | CTA | RVD | CAA | CCA | CGA | CTA |
|---|---|---|---|---|---|---|---|---|---|
| DH | 0.01 | 0.01 | 0.36 | 0.03 | DL | 0.01 | 0.00 | 0.00 | 0.03 |
| EH | 0.02 | 0.03 | 0.17 | 0.13 | EL | 0.02 | 0.00 | 0.00 | 0.03 |
| FH | 0.00 | 0.00 | 0.02 | 0.04 | FL | 0.01 | 0.00 | 0.00 | 0.02 |
| GH | 0.00 | 0.01 | 0.12 | 0.01 | GL | 0.02 | 0.01 | 0.00 | 0.04 |
| HH | 0.05 | 0.07 | 0.37 | 0.17 | HL | 0.04 | 0.00 | 0.00 | 0.00 |
| IH | 0.00 | 0.01 | 0.02 | 0.07 | IL | 0.02 | 0.00 | 0.00 | 0.03 |
| KH | 0.01 | 0.01 | 0.12 | 0.09 | KL | 0.07 | 0.00 | 0.00 | 0.01 |
| LH | 0.00 | 0.00 | 0.00 | 0.00 | LL | 0.00 | 0.00 | 0.00 | 0.02 |
| MH | 0.00 | 0.01 | 0.01 | 0.03 | ML | 0.01 | 0.00 | 0.00 | 0.01 |
| NH | 0.03 | 0.02 | 0.18 | 0.09 | NL | 0.02 | 0.00 | 0.00 | 0.00 |
| PH | 0.00 | 0.00 | 0.00 | 0.01 | PL | 0.00 | 0.00 | 0.00 | 0.03 |
| QH | 0.02 | 0.03 | 0.09 | 0.09 | QL | 0.02 | 0.00 | 0.00 | 0.00 |
| RH | 0.05 | 0.03 | 0.39 | 0.05 | RL | 0.14 | 0.01 | 0.00 | 0.01 |
| SH | 0.02 | 0.02 | 0.06 | 0.06 | SL | 0.02 | 0.01 | 0.01 | 0.07 |
| TH | 0.01 | 0.02 | 0.11 | 0.08 | TL | 0.06 | 0.09 | 0.08 | 0.16 |
| VH | 0.01 | 0.01 | 0.01 | 0.11 | VL | 0.01 | 0.00 | 0.00 | 0.00 |
| WH | 0.00 | 0.00 | 0.01 | 0.01 | WL | 0.02 | 0.02 | 0.01 | 0.12 |
| YH | 0.01 | 0.01 | 0.02 | 0.02 | YL | 0.03 | 0.03 | 0.01 | 0.08 |
| AI | 0.33 | 0.02 | 0.00 | 0.03 | AM | 0.06 | 0.00 | 0.05 | 0.03 |
| CI | 0.46 | 0.04 | 0.01 | 0.04 | CM | 0.06 | 0.00 | 0.07 | 0.02 |
| DI | 0.18 | 0.01 | 0.01 | 0.00 | DM | 0.03 | 0.00 | 0.02 | 0.01 |
| EI | 0.37 | 0.06 | 0.00 | 0.01 | EM | 0.09 | 0.16 | 0.04 | 0.20 |
| FI | 0.13 | 0.00 | 0.00 | 0.00 | FM | 0.02 | 0.00 | 0.03 | 0.00 |
| GI | 0.07 | 0.01 | 0.01 | 0.01 | GM | 0.04 | 0.06 | 0.04 | 0.16 |
| HI | 0.67 | 0.10 | 0.04 | 0.04 | HM | 0.30 | 0.28 | 0.00 | 0.03 |
| II | 0.05 | 0.01 | 0.00 | 0.03 | IM | 0.07 | 0.13 | 0.03 | 0.14 |
| KI | 0.75 | 0.11 | 0.02 | 0.04 | KM | 0.03 | 0.03 | 0.00 | 0.01 |
| LI | 0.01 | 0.00 | 0.00 | 0.00 | LM | 0.05 | 0.08 | 0.04 | 0.17 |
| MI | 0.05 | 0.00 | 0.00 | 0.01 | MM | 0.02 | 0.04 | 0.03 | 0.10 |
| NI | 0.60 | 0.04 | 0.02 | 0.02 | NM | 0.05 | 0.06 | 0.00 | 0.00 |
| PI | 0.01 | 0.00 | 0.00 | 0.01 | PM | 0.01 | 0.02 | 0.03 | 0.13 |
| QI | 0.30 | 0.05 | 0.00 | 0.04 | QM | 0.11 | 0.12 | 0.01 | 0.22 |
| RI | 0.65 | 0.05 | 0.02 | 0.02 | RM | 0.17 | 0.09 | 0.00 | 0.02 |
| SI | 0.29 | 0.02 | 0.00 | 0.03 | SM | 0.11 | 0.16 | 0.03 | 0.17 |
| TI | 0.32 | 0.11 | 0.00 | 0.05 | TM | 0.04 | 0.08 | 0.03 | 0.05 |
| VI | 0.15 | 0.04 | 0.00 | 0.07 | VM | 0.04 | 0.09 | 0.04 | 0.05 |
| WI | 0.06 | 0.00 | 0.00 | 0.01 | WM | 0.02 | 0.04 | 0.02 | 0.03 |
| YI | 0.15 | 0.01 | 0.00 | 0.01 | YM | 0.05 | 0.11 | 0.05 | 0.06 |
| AK | 0.00 | 0.00 | 0.21 | 0.01 | AN | 0.51 | 0.00 | 0.87 | 0.01 |
| CK | 0.00 | 0.00 | 0.10 | 0.00 | CN | 0.17 | 0.00 | 0.49 | 0.02 |
| DK | 0.00 | 0.00 | 0.15 | 0.00 | DN | 0.12 | 0.00 | 0.37 | 0.01 |
| EK | 0.00 | 0.00 | 0.11 | 0.00 | EN | 0.19 | 0.00 | 0.49 | 0.01 |
| FK | 0.00 | 0.00 | 0.04 | 0.00 | FN | 0.12 | 0.00 | 0.37 | 0.01 |
| GK | 0.01 | 0.00 | 0.09 | 0.04 | GN | 0.12 | 0.00 | 0.32 | 0.02 |
| HK | 0.00 | 0.00 | 0.06 | 0.00 | HN | 0.50 | 0.00 | 0.86 | 0.01 |
| IK | 0.00 | 0.00 | 0.07 | 0.01 | IN | 0.05 | 0.00 | 0.17 | 0.03 |
| KK | 0.00 | 0.00 | 0.08 | 0.01 | KN | 0.71 | 0.00 | 1.00 | 0.02 |
| LK | 0.00 | 0.00 | 0.01 | 0.00 | LN | 0.03 | 0.00 | 0.15 | 0.00 |
| MK | 0.00 | 0.00 | 0.01 | 0.00 | MN | 0.08 | 0.00 | 0.21 | 0.01 |
| NK | 0.00 | 0.00 | 0.15 | 0.00 | NN | 0.47 | 0.00 | 0.81 | 0.00 |
| PK | 0.00 | 0.00 | 0.00 | 0.00 | PN | 0.00 | 0.00 | 0.02 | 0.01 |
| QK | 0.00 | 0.00 | 0.15 | 0.01 | QN | 0.16 | 0.00 | 0.48 | 0.02 |
| RK | 0.00 | 0.00 | 0.12 | 0.00 | RN | 0.31 | 0.00 | 0.55 | 0.01 |
| SK | 0.00 | 0.01 | 0.07 | 0.02 | SN | 0.43 | 0.01 | 0.92 | 0.02 |
| TK | 0.00 | 0.00 | 0.09 | 0.01 | TN | 0.12 | 0.00 | 0.32 | 0.03 |
| VK | 0.00 | 0.00 | 0.01 | 0.00 | VN | 0.08 | 0.00 | 0.30 | 0.02 |
| WK | 0.00 | 0.00 | 0.02 | 0.00 | WN | 0.13 | 0.00 | 0.36 | 0.01 |
| YK | 0.00 | 0.00 | 0.04 | 0.00 | YN | 0.18 | 0.00 | 0.48 | 0.01 |
| AW | 0.00 | 0.00 | 0.00 | 0.01 | AY | 0.02 | 0.00 | 0.00 | 0.01 |
| CW | 0.00 | 0.00 | 0.00 | 0.01 | CY | 0.00 | 0.00 | 0.00 | 0.01 |
| DW | 0.00 | 0.00 | 0.00 | 0.01 | DY | 0.00 | 0.00 | 0.00 | 0.01 |
| EW | 0.00 | 0.00 | 0.00 | 0.00 | EY | 0.00 | 0.00 | 0.00 | 0.01 |
| FW | 0.00 | 0.00 | 0.00 | 0.01 | FY | 0.00 | 0.00 | 0.00 | 0.01 |
| GW | 0.00 | 0.00 | 0.00 | 0.02 | GY | 0.01 | 0.00 | 0.01 | 0.02 |
| HW | 0.00 | 0.00 | 0.00 | 0.00 | HY | 0.01 | 0.00 | 0.00 | 0.00 |
| IW | 0.00 | 0.01 | 0.01 | 0.01 | IY | 0.00 | 0.00 | 0.00 | 0.01 |
| KW | 0.00 | 0.00 | 0.00 | 0.00 | KY | 0.03 | 0.00 | 0.00 | 0.00 |
| LW | 0.00 | 0.00 | 0.00 | 0.01 | LY | 0.00 | 0.00 | 0.00 | 0.01 |
| MW | 0.00 | 0.00 | 0.00 | 0.01 | MY | 0.00 | 0.00 | 0.00 | 0.00 |
| NW | 0.00 | 0.00 | 0.00 | 0.00 | NY | 0.03 | 0.00 | 0.00 | 0.00 |
| PW | 0.00 | 0.00 | 0.00 | 0.00 | PY | 0.00 | 0.00 | 0.00 | 0.00 |
| QW | 0.01 | 0.00 | 0.00 | 0.00 | QY | 0.01 | 0.00 | 0.00 | 0.00 |
| RW | 0.00 | 0.00 | 0.01 | 0.01 | RY | 0.06 | 0.01 | 0.00 | 0.00 |
| SW | 0.01 | 0.03 | 0.00 | 0.18 | SY | 0.01 | 0.01 | 0.00 | 0.02 |
| TW | 0.00 | 0.00 | 0.00 | 0.01 | TY | 0.01 | 0.00 | 0.00 | 0.00 |
| VW | 0.00 | 0.00 | 0.00 | 0.00 | VY | 0.00 | 0.00 | 0.00 | 0.00 |
| WW | 0.00 | 0.00 | 0.01 | 0.01 | WY | 0.00 | 0.00 | 0.00 | 0.00 |
| YW | 0.00 | 0.00 | 0.00 | 0.00 | YY | 0.00 | 0.00 | 0.00 | 0.00 |

This data is also presented in FIG. 28 where the data is shown in a 20×20 grid. The first amino acid of the RVD (position 12) is indicated to the left of the grid and the second amino acid of the RVD (position 13) is indicated above the grid. The size of the letters A, C, G, and T in each grid is scaled based on the square root of the normalized ELISA signal for the CAA site, CCA site, and CGA site and CTA site respectively. The boxed RVDs indicate frequently occurring natural RVDs found in TALE proteins encoded by Xanthomonas. Many RVDs have improved DNA binding properties with respect to the naturally occurring HD, NI, NG, NS, NN, IG, HG, and NK RVDs. Exemplary novel RVDs and their cognate nucleotide bases include where N represents positive interaction with all bases:

A: RI, KI, HI

C: ND, KD, AD

G: DH, SN, AK, AN, DK, HN

T: VG, IA, IP, TP, QA, YG, LA, SG, HA, NA, GG, KG, QG

N: KS, AT, KT, RA.

Studies were also undertaken to purposely alter the RVD sequences to specific sequences hypothesized to be candidate novel binders through an analysis of the known RVDs. Thus, the following RVDs have been tested:

| RVD | Intended target |
|---|---|
| NV, NT, NL, HI, SI, LI | A |
| HE, NE, SE, ND, SD, LD | C |
| HR, NR, SR, HH, NH, SH, HN, HK, SN, SK, LN, LK | G |
| NP, NA, HA, HG, SG, LG | T |

Oligonucleotides were made to allow the specific alteration of the TALE construct described above. These specific oligonucleotides are then cloned into the expression vectors and assembled as described in Example 11, and resultant protein extracts are analyzed by DNA-binding ELISA and SELEX to determine the binding characteristics of the RVDs.

Twelve of these TALE DNA binding domains comprising the atypical RVDs were subjected to SELEX analysis as described above. The results from the SELEX analysis are shown below in Table 28. In the table, the data for the natural RVD (in bold in the 'RVD' column) is presented along with the exemplary novel RVD, and show that in many cases, the novel RVD demonstrates equal or greater preference for the targeted bases as compared with the natural RVD.

TABLE 28

SELEX results from novel RVDs:

| RVD | Target | Library | Base frequency matrix | | | | | | | | | | | |
|---|---|---|---|---|---|---|---|---|---|---|---|---|---|---|
| DI | A | N18CG | A | 0.00 | 0.00 | 0.00 | 1.00 | 0.00 | 1.00 | 1.00 | 0.00 | 0.00 | 0.00 | 0.00 |
|  |  |  | C | 0.00 | 0.00 | 0.00 | 0.00 | 1.00 | 0.00 | 0.00 | 0.00 | 1.00 | 1.00 | 0.00 |
|  |  |  | G | 0.00 | 0.00 | 1.00 | 0.00 | 0.00 | 0.00 | 0.00 | 0.00 | 0.00 | 0.00 | 0.00 |
|  |  |  | T | 1.00 | 1.00 | 0.00 | 0.00 | 0.00 | 0.00 | 0.00 | 1.00 | 0.00 | 0.00 | 1.00 |
| EI | A | N18CG | A | 0.00 | 0.02 | 0.00 | 1.00 | 0.00 | 1.00 | 1.00 | 0.00 | 0.00 | 0.00 | 0.00 |
|  |  |  | C | 0.00 | 0.00 | 0.00 | 0.00 | 1.00 | 0.00 | 0.00 | 0.00 | 1.00 | 1.00 | 0.00 |
|  |  |  | G | 0.00 | 0.00 | 1.00 | 0.00 | 0.00 | 0.00 | 0.00 | 0.00 | 0.00 | 0.00 | 0.00 |
|  |  |  | T | 1.00 | 0.98 | 0.00 | 0.00 | 0.00 | 0.00 | 0.00 | 1.00 | 0.00 | 0.00 | 1.00 |
| AI | A | N18CG | A | 0.02 | 0.00 | 0.00 | 1.00 | 0.02 | 1.00 | 1.00 | 0.00 | 0.00 | 0.00 | 0.02 |
|  |  |  | C | 0.00 | 0.00 | 0.00 | 0.00 | 0.98 | 0.00 | 0.00 | 0.00 | 0.98 | 1.00 | 0.00 |
|  |  |  | G | 0.00 | 0.02 | 1.00 | 0.00 | 0.00 | 0.00 | 0.00 | 0.00 | 0.02 | 0.00 | 0.00 |
|  |  |  | T | 0.98 | 0.98 | 0.00 | 0.00 | 0.00 | 0.00 | 0.00 | 1.00 | 0.00 | 0.00 | 0.98 |
| CI | A | N18CG | A | 0.00 | 0.07 | 0.00 | 1.00 | 0.00 | 1.00 | 1.00 | 0.00 | 0.00 | 0.00 | 0.00 |
|  |  |  | C | 0.00 | 0.00 | 0.00 | 0.00 | 1.00 | 0.00 | 0.00 | 0.00 | 1.00 | 1.00 | 0.00 |
|  |  |  | G | 0.00 | 0.00 | 1.00 | 0.00 | 0.00 | 0.00 | 0.00 | 0.00 | 0.00 | 0.00 | 0.00 |
|  |  |  | T | 1.00 | 0.93 | 0.00 | 0.00 | 0.00 | 0.00 | 0.00 | 1.00 | 0.00 | 0.00 | 1.00 |
| HI | A | N18CG | A | 0.00 | 0.10 | 0.00 | 1.00 | 0.00 | 1.00 | 1.00 | 0.00 | 0.00 | 0.00 | 0.00 |
|  |  |  | C | 0.00 | 0.00 | 0.00 | 0.00 | 1.00 | 0.00 | 0.00 | 0.00 | 1.00 | 1.00 | 0.00 |
|  |  |  | G | 0.00 | 0.03 | 1.00 | 0.00 | 0.00 | 0.00 | 0.00 | 0.00 | 0.00 | 0.00 | 0.00 |
|  |  |  | T | 1.00 | 0.88 | 0.00 | 0.00 | 0.00 | 0.00 | 0.00 | 1.00 | 0.00 | 0.00 | 1.00 |
| KI | A | N18CG | A | 0.00 | 0.20 | 0.00 | 1.00 | 0.00 | 1.00 | 1.00 | 0.00 | 0.00 | 0.00 | 0.00 |
|  |  |  | C | 0.00 | 0.00 | 0.00 | 0.00 | 1.00 | 0.00 | 0.00 | 0.00 | 1.00 | 1.00 | 0.00 |
|  |  |  | G | 0.00 | 0.00 | 1.00 | 0.00 | 0.00 | 0.00 | 0.00 | 0.00 | 0.00 | 0.00 | 0.00 |
|  |  |  | T | 1.00 | 0.80 | 0.00 | 0.00 | 0.00 | 0.00 | 0.00 | 1.00 | 0.00 | 0.00 | 1.00 |
| RI | A | N18CG | A | 0.00 | 0.00 | 0.00 | 1.00 | 0.00 | 1.00 | 1.00 | 0.00 | 0.00 | 0.00 | 0.00 |
|  |  |  | C | 0.00 | 0.00 | 0.00 | 0.00 | 1.00 | 0.00 | 0.00 | 0.00 | 1.00 | 1.00 | 0.00 |
|  |  |  | G | 0.00 | 0.00 | 1.00 | 0.00 | 0.00 | 0.00 | 0.00 | 0.00 | 0.00 | 0.00 | 0.00 |
|  |  |  | T | 1.00 | 1.00 | 0.00 | 0.00 | 0.00 | 0.00 | 0.00 | 1.00 | 0.00 | 0.00 | 1.00 |
| NI | A | N18CG | A | 0.00 | 0.04 | 0.00 | 1.00 | 0.00 | 0.91 | 0.96 | 0.00 | 0.00 | 0.00 | 0.00 |
|  |  |  | C | 0.00 | 0.00 | 0.00 | 0.00 | 1.00 | 0.00 | 0.00 | 0.00 | 1.00 | 1.00 | 0.00 |
|  |  |  | G | 0.00 | 0.00 | 1.00 | 0.00 | 0.00 | 0.09 | 0.04 | 0.00 | 0.00 | 0.00 | 0.00 |
|  |  |  | T | 1.00 | 0.96 | 0.00 | 0.00 | 0.00 | 0.00 | 0.00 | 1.00 | 0.00 | 0.00 | 1.00 |
| YD | C | N18CG | A | 0.00 | 0.00 | 0.00 | 1.00 | 0.00 | 0.00 | 0.96 | 0.00 | 0.00 | 0.00 | 0.00 |
|  |  |  | C | 0.00 | 0.00 | 0.00 | 0.00 | 1.00 | 1.00 | 0.04 | 0.00 | 1.00 | 1.00 | 0.00 |
|  |  |  | G | 0.00 | 0.00 | 1.00 | 0.00 | 0.00 | 0.00 | 0.00 | 0.00 | 0.00 | 0.00 | 0.00 |
|  |  |  | T | 1.00 | 1.00 | 0.00 | 0.00 | 0.00 | 0.00 | 0.00 | 1.00 | 0.00 | 0.00 | 1.00 |
| ED | C | N18CG | A | 0.00 | 0.00 | 0.00 | 0.94 | 0.03 | 0.00 | 0.97 | 0.00 | 0.03 | 0.00 | 0.00 |
|  |  |  | C | 0.00 | 0.00 | 0.00 | 0.00 | 0.97 | 0.94 | 0.03 | 0.00 | 0.97 | 1.00 | 0.00 |
|  |  |  | G | 0.00 | 0.00 | 1.00 | 0.03 | 0.00 | 0.00 | 0.00 | 0.00 | 0.00 | 0.00 | 0.00 |
|  |  |  | T | 1.00 | 1.00 | 0.00 | 0.03 | 0.00 | 0.06 | 0.00 | 1.00 | 0.00 | 0.00 | 1.00 |
| RD | C | N18CG | A | 0.00 | 0.00 | 0.00 | 1.00 | 0.00 | 0.02 | 0.88 | 0.00 | 0.00 | 0.02 | 0.00 |
|  |  |  | C | 0.00 | 0.00 | 0.00 | 0.00 | 1.00 | 0.98 | 0.05 | 0.00 | 1.00 | 0.98 | 0.00 |
|  |  |  | G | 0.00 | 0.00 | 1.00 | 0.00 | 0.00 | 0.00 | 0.07 | 0.00 | 0.00 | 0.00 | 0.00 |
|  |  |  | T | 1.00 | 1.00 | 0.00 | 0.00 | 0.00 | 0.00 | 0.00 | 1.00 | 0.00 | 0.00 | 1.00 |

TABLE 28-continued

SELEX results from novel RVDs:

| RVD | Target | Library | Base frequency matrix | | | | | | | | | | | | RVD location |
|---|---|---|---|---|---|---|---|---|---|---|---|---|---|---|---|
| AD | C | N18CG | A | 0.00 | 0.00 | 0.00 | 0.97 | 0.00 | 0.00 | 0.84 | 0.00 | 0.00 | 0.00 | 0.00 | |
| | | | C | 0.00 | 0.00 | 0.00 | 0.03 | 1.00 | 0.97 | 0.13 | 0.00 | 1.00 | 1.00 | 0.00 | |
| | | | G | 0.00 | 0.00 | 0.97 | 0.00 | 0.00 | 0.00 | 0.00 | 0.00 | 0.00 | 0.00 | 0.00 | |
| | | | T | 1.00 | 1.00 | 0.03 | 0.00 | 0.00 | 0.03 | 0.03 | 1.00 | 0.00 | 0.00 | 1.00 | |
| KD | C | N18CG | A | 0.00 | 0.00 | 0.00 | 0.96 | 0.04 | 0.00 | 0.89 | 0.00 | 0.00 | 0.00 | 0.00 | |
| | | | C | 0.00 | 0.00 | 0.04 | 0.00 | 0.96 | 0.96 | 0.14 | 0.00 | 1.00 | 1.00 | 0.00 | |
| | | | G | 0.00 | 0.00 | 0.96 | 0.00 | 0.00 | 0.00 | 0.00 | 0.00 | 0.00 | 0.00 | 0.00 | |
| | | | T | 1.00 | 1.00 | 0.00 | 0.04 | 0.00 | 0.04 | 0.00 | 1.00 | 0.00 | 0.00 | 1.00 | |
| ND | C | N18CG | A | 0.00 | 0.07 | 0.00 | 1.00 | 0.00 | 0.00 | 0.93 | 0.00 | 0.00 | 0.00 | 0.00 | |
| | | | C | 0.00 | 0.00 | 0.00 | 0.00 | 1.00 | 1.00 | 0.07 | 0.00 | 1.00 | 1.00 | 0.03 | |
| | | | G | 0.00 | 0.00 | 1.00 | 0.00 | 0.00 | 0.00 | 0.00 | 0.00 | 0.00 | 0.00 | 0.00 | |
| | | | T | 1.00 | 0.93 | 0.00 | 0.00 | 0.00 | 0.00 | 0.00 | 1.00 | 0.00 | 0.00 | 0.97 | |
| HD | C | N18CG | A | 0.00 | 0.03 | 0.00 | 1.00 | 0.00 | 0.00 | 0.93 | 0.00 | 0.00 | 0.00 | 0.00 | |
| | | | C | 0.00 | 0.00 | 0.00 | 0.00 | 1.00 | 1.00 | 0.07 | 0.00 | 1.00 | 1.00 | 0.00 | |
| | | | G | 0.00 | 0.00 | 1.00 | 0.00 | 0.00 | 0.00 | 0.00 | 0.00 | 0.00 | 0.00 | 0.00 | |
| | | | T | 1.00 | 0.97 | 0.00 | 0.00 | 0.00 | 0.00 | 0.00 | 1.00 | 0.00 | 0.00 | 1.00 | |
| HN | G | N18CG | A | 0.05 | 0.15 | 0.03 | 1.00 | 0.03 | 0.13 | 0.80 | 0.00 | 0.00 | 0.05 | 0.00 | |
| | | | C | 0.00 | 0.00 | 0.00 | 0.00 | 0.98 | 0.00 | 0.13 | 0.00 | 1.00 | 0.95 | 0.00 | |
| | | | G | 0.00 | 0.00 | 0.98 | 0.00 | 0.00 | 0.88 | 0.08 | 0.00 | 0.00 | 0.00 | 0.00 | |
| | | | T | 0.95 | 0.85 | 0.00 | 0.00 | 0.00 | 0.00 | 0.00 | 1.00 | 0.00 | 0.00 | 1.00 | |
| DK | G | N18CG | A | 0.00 | 0.02 | 0.00 | 1.00 | 0.02 | 0.00 | 0.12 | 0.02 | 0.00 | 0.02 | 0.00 | |
| | | | C | 0.02 | 0.00 | 0.00 | 0.00 | 0.98 | 0.00 | 0.02 | 0.00 | 0.98 | 0.98 | 0.00 | |
| | | | G | 0.00 | 0.00 | 1.00 | 0.00 | 0.00 | 1.00 | 0.85 | 0.00 | 0.00 | 0.00 | 0.00 | |
| | | | T | 0.98 | 0.98 | 0.00 | 0.00 | 0.00 | 0.00 | 0.00 | 0.98 | 0.02 | 0.00 | 1.00 | |
| AN | G | N18CG | A | 0.00 | 0.02 | 0.00 | 1.00 | 0.00 | 0.00 | 0.76 | 0.00 | 0.00 | 0.02 | 0.00 | |
| | | | C | 0.00 | 0.00 | 0.00 | 0.00 | 1.00 | 0.00 | 0.07 | 0.00 | 1.00 | 0.98 | 0.00 | |
| | | | G | 0.00 | 0.00 | 1.00 | 0.00 | 0.00 | 1.00 | 0.17 | 0.00 | 0.00 | 0.00 | 0.00 | |
| | | | T | 1.00 | 0.98 | 0.00 | 0.00 | 0.00 | 0.00 | 0.00 | 1.00 | 0.00 | 0.00 | 1.00 | |
| NK | G | N18CG | A | 0.00 | 0.09 | 0.00 | 1.00 | 0.00 | 0.00 | 0.00 | 0.00 | 0.00 | 0.00 | 0.00 | |
| | | | C | 0.00 | 0.00 | 0.00 | 0.00 | 0.98 | 0.00 | 0.00 | 0.00 | 1.00 | 1.00 | 0.00 | |
| | | | G | 0.00 | 0.00 | 1.00 | 0.00 | 0.00 | 1.00 | 1.00 | 0.00 | 0.00 | 0.00 | 0.00 | |
| | | | T | 1.00 | 0.91 | 0.00 | 0.00 | 0.02 | 0.00 | 0.00 | 1.00 | 0.00 | 0.00 | 1.00 | |
| DH | G | N18CG | A | 0.00 | 0.00 | 0.00 | 1.00 | 0.00 | 0.00 | 1.00 | 0.00 | 0.00 | 0.00 | 0.00 | |
| | | | C | 0.00 | 0.00 | 0.00 | 0.00 | 1.00 | 0.00 | 0.00 | 0.00 | 1.00 | 1.00 | 0.00 | |
| | | | G | 0.00 | 0.00 | 1.00 | 0.00 | 0.00 | 1.00 | 0.00 | 0.00 | 0.00 | 0.00 | 0.00 | |
| | | | T | 1.00 | 1.00 | 0.00 | 0.00 | 0.00 | 0.00 | 0.00 | 1.00 | 0.00 | 0.00 | 1.00 | |
| AK | G | N18CG | A | 0.00 | 0.00 | 0.00 | 1.00 | 0.00 | 0.00 | 0.00 | 0.00 | 0.00 | 0.00 | 0.00 | |
| | | | C | 0.00 | 0.00 | 0.00 | 0.00 | 1.00 | 0.00 | 0.00 | 0.03 | 1.00 | 1.00 | 0.00 | |
| | | | G | 0.00 | 0.00 | 1.00 | 0.00 | 0.00 | 1.00 | 1.00 | 0.00 | 0.00 | 0.00 | 0.00 | |
| | | | T | 1.00 | 1.00 | 0.00 | 0.00 | 0.00 | 0.00 | 0.00 | 0.97 | 0.00 | 0.00 | 1.00 | |
| SN | G | N18CG | A | 0.00 | 0.07 | 0.00 | 1.00 | 0.00 | 0.07 | 1.00 | 0.00 | 0.00 | 0.00 | 0.00 | |
| | | | C | 0.00 | 0.00 | 0.00 | 0.00 | 1.00 | 0.00 | 0.00 | 0.00 | 1.00 | 1.00 | 0.00 | |
| | | | G | 0.00 | 0.00 | 1.00 | 0.00 | 0.00 | 0.93 | 0.00 | 0.00 | 0.00 | 0.00 | 0.00 | |
| | | | T | 1.00 | 0.93 | 0.00 | 0.00 | 0.00 | 0.00 | 0.00 | 1.00 | 0.00 | 0.00 | 1.00 | |

TABLE 28-continued

SELEX results from novel RVDs:

RVD Target Library Base frequency matrix RVD location

| RVD | Target | Library | | 1 | 2 | 3 | 4 | 5 | 6 | 7 | 8 | 9 | 10 | 11 |
|---|---|---|---|---|---|---|---|---|---|---|---|---|---|---|
| NN | G | N18CG | A | 0.00 | 0.06 | 0.00 | 1.00 | 0.00 | 0.04 | 0.92 | 0.00 | 0.00 | 0.00 | 0.00 |
| | | | C | 0.00 | 0.00 | 0.00 | 0.00 | 1.00 | 0.00 | 0.00 | 0.00 | 1.00 | 1.00 | 0.00 |
| | | | G | 0.00 | 0.00 | 1.00 | 0.00 | 0.00 | 0.96 | 0.08 | 0.00 | 0.00 | 0.00 | 0.00 |
| | | | T | 1.00 | 0.94 | 0.00 | 0.00 | 0.00 | 0.00 | 0.00 | 1.00 | 0.00 | 0.00 | 1.00 |
| IP | T | N18CG | A | 0.00 | 0.02 | 0.00 | 1.00 | 0.00 | 0.00 | 0.98 | 0.00 | 0.00 | 0.00 | 0.00 |
| | | | C | 0.00 | 0.00 | 0.00 | 0.00 | 1.00 | 0.05 | 0.00 | 0.00 | 1.00 | 1.00 | 0.02 |
| | | | G | 0.00 | 0.00 | 1.00 | 0.00 | 0.00 | 0.00 | 0.02 | 0.00 | 0.00 | 0.00 | 0.00 |
| | | | T | 1.00 | 0.98 | 0.00 | 0.00 | 0.00 | 0.95 | 0.00 | 1.00 | 0.00 | 0.00 | 0.98 |
| LA | T | N18CG | A | 0.00 | 0.00 | 0.00 | 1.00 | 0.00 | 0.00 | 0.93 | 0.00 | 0.00 | 0.00 | 0.00 |
| | | | C | 0.00 | 0.00 | 0.00 | 0.00 | 1.00 | 0.02 | 0.00 | 0.00 | 1.00 | 1.00 | 0.00 |
| | | | G | 0.00 | 0.00 | 1.00 | 0.00 | 0.00 | 0.00 | 0.07 | 0.00 | 0.00 | 0.00 | 0.00 |
| | | | T | 1.00 | 1.00 | 0.00 | 0.00 | 0.00 | 0.98 | 0.00 | 1.00 | 0.00 | 0.00 | 1.00 |
| YG | T | N18CG | A | 0.02 | 0.00 | 0.00 | 0.98 | 0.02 | 0.00 | 0.95 | 0.00 | 0.00 | 0.00 | 0.00 |
| | | | C | 0.00 | 0.02 | 0.00 | 0.00 | 0.98 | 0.00 | 0.00 | 0.00 | 1.00 | 1.00 | 0.00 |
| | | | G | 0.00 | 0.00 | 0.98 | 0.00 | 0.00 | 0.00 | 0.05 | 0.00 | 0.00 | 0.00 | 0.00 |
| | | | T | 0.98 | 0.98 | 0.02 | 0.02 | 0.00 | 1.00 | 0.00 | 1.00 | 0.00 | 0.00 | 1.00 |
| IG | T | N18CG | A | 0.00 | 0.00 | 0.00 | 1.00 | 0.00 | 0.00 | 0.98 | 0.00 | 0.00 | 0.00 | 0.00 |
| | | | C | 0.00 | 0.00 | 0.00 | 0.00 | 1.00 | 0.00 | 0.00 | 0.00 | 1.00 | 1.00 | 0.03 |
| | | | G | 0.00 | 0.00 | 1.00 | 0.00 | 0.00 | 0.00 | 0.03 | 0.00 | 0.00 | 0.00 | 0.00 |
| | | | T | 1.00 | 1.00 | 0.00 | 0.00 | 0.00 | 1.00 | 0.00 | 1.00 | 0.00 | 0.00 | 0.98 |
| SG | T | N18CG | A | 0.00 | 0.04 | 0.02 | 1.00 | 0.00 | 0.04 | 1.00 | 0.00 | 0.00 | 0.00 | 0.00 |
| | | | C | 0.00 | 0.00 | 0.00 | 0.00 | 0.98 | 0.00 | 0.00 | 0.00 | 1.00 | 1.00 | 0.00 |
| | | | G | 0.00 | 0.00 | 0.98 | 0.00 | 0.00 | 0.00 | 0.00 | 0.00 | 0.00 | 0.00 | 0.00 |
| | | | T | 1.00 | 0.96 | 0.00 | 0.00 | 0.02 | 0.96 | 0.00 | 1.00 | 0.00 | 0.00 | 1.00 |
| VG | T | N18CG | A | 0.00 | 0.00 | 0.00 | 1.00 | 0.02 | 0.09 | 0.91 | 0.00 | 0.00 | 0.00 | 0.02 |
| | | | C | 0.00 | 0.00 | 0.00 | 0.00 | 0.98 | 0.00 | 0.00 | 0.09 | 1.00 | 0.91 | 0.02 |
| | | | G | 0.00 | 0.00 | 1.00 | 0.00 | 0.00 | 0.00 | 0.00 | 0.00 | 0.00 | 0.00 | 0.00 |
| | | | T | 1.00 | 1.00 | 0.00 | 0.00 | 0.00 | 0.91 | 0.09 | 0.91 | 0.00 | 0.09 | 0.96 |
| TP | T | N18CG | A | 0.00 | 0.00 | 0.00 | 1.00 | 0.00 | 0.00 | 0.97 | 0.00 | 0.00 | 0.00 | 0.00 |
| | | | C | 0.00 | 0.00 | 0.00 | 0.00 | 1.00 | 0.00 | 0.00 | 0.00 | 1.00 | 1.00 | 0.00 |
| | | | G | 0.00 | 0.00 | 1.00 | 0.00 | 0.00 | 0.00 | 0.03 | 0.00 | 0.00 | 0.00 | 0.00 |
| | | | T | 1.00 | 1.00 | 0.00 | 0.00 | 0.00 | 1.00 | 0.00 | 1.00 | 0.00 | 0.00 | 1.00 |
| IA | T | N18CG | A | 0.00 | 0.03 | 0.00 | 1.00 | 0.00 | 0.00 | 0.97 | 0.00 | 0.00 | 0.00 | 0.00 |
| | | | C | 0.00 | 0.00 | 0.00 | 0.00 | 1.00 | 0.00 | 0.00 | 0.00 | 1.00 | 1.00 | 0.00 |
| | | | G | 0.00 | 0.00 | 1.00 | 0.00 | 0.00 | 0.00 | 0.03 | 0.00 | 0.00 | 0.00 | 0.00 |
| | | | T | 1.00 | 0.97 | 0.00 | 0.00 | 0.00 | 1.00 | 0.00 | 1.00 | 0.00 | 0.00 | 1.00 |
| NG | T | N18CG | A | 0.00 | 0.03 | 0.00 | 1.00 | 0.03 | 0.00 | 0.97 | 0.00 | 0.00 | 0.00 | 0.00 |
| | | | C | 0.00 | 0.03 | 0.00 | 0.00 | 0.97 | 0.00 | 0.00 | 0.00 | 1.00 | 1.00 | 0.00 |
| | | | G | 0.00 | 0.00 | 1.00 | 0.00 | 0.00 | 0.00 | 0.03 | 0.00 | 0.00 | 0.00 | 0.00 |
| | | | T | 1.00 | 0.95 | 0.00 | 0.00 | 0.00 | 1.00 | 0.00 | 1.00 | 0.00 | 0.00 | 1.00 |

These RVDs were then tested for activity in the context of a full length TALEN. A CCR5-specific 18 repeat TALEN was produced with all novel RVDs for comparison with the CCR5-specific TALEN described in Example 12. The target sites for this TALEN pair is reshown below. The 101041 TALEN monomer was the partner that was modified while the 101047 partner was left with all natural RVDs(SEQ ID NOS 462-463, respectively, in order of appearance):

```
                                            101041(L538)
5'-GTCTTCATTACACCTGCAGCTCTCATTTTCCATACAGTCAGTATCAATTCTGGAAGAATTTCCAGACATT
   CAGAAGTAATGTGGACGTCGAGAGTAAAAGGTATGTCAGTCATAGTTAAGACCTTCTTAAAGGTCTGTAA-5'
                                                     101047 (R557)
```

In addition, CCR5-specific TALENs comprising both typical and novel (atypical) RVDs were also constructed in CCR5 specific TALENs in which novel RVDs were substituted of all one type, for example, all RVDs recognizing 'T' or 'A'. The code described previously in Examples 11 and 12 for the typical RVDs was used, i.e. A=NI, C=HD, G=NN, T=NG. For The novel RVDs, the following were tested in this initial analysis: A=HI, NI or KI; C=ND, KD, cND; G=SN, AK, DH, cHN, KN; T=TP, IA, VG, SGgs(SEQ ID NO 464), or IP. When lower case letters are used, these indicate alterations of the positions adjacent to the RVD positions, for example "cND" indicates that positions 11, 12 and 13 in the repeat unit were altered. For these studies, candidate RVDs were chosen by the data presented in Table 27B and used to create proof of principal proteins. Additional TALE proteins may be constructed using alternative atypical RVDs from the entire set. In addition, atypical RVDs may be chosen such that a mixture of RVDs specifying a base may be created (e.g. one TALEN protein may be constructed using both TP and IA RVDs to specify 'T' in different positions).

The RVD sequences for the repeat units are shown below in Tables 29A-29C and all mutated positions are indicated in bold font.

TABLE 29A

All novel (atypical) RVD substitution

| RVD Substitution | TALEN | T | C | A | T | T | A | C | A | C | C | T | G | C | A | G | C | T |
|---|---|---|---|---|---|---|---|---|---|---|---|---|---|---|---|---|---|---|
| Full | 101726 | TP | ND | HI | TP | TP | HI | ND | HI | ND | ND | TP | SN | ND | HI | SN | ND | TP |
|  | 101727 | IA | ND | HI | IA | IA | HI | ND | HI | ND | ND | IA | SN | ND | HI | SN | ND | IA |
|  | 101728 | VG | ND | HI | VG | VG | HI | ND | HI | ND | ND | VG | SN | ND | HI | SN | ND | VG |
|  | 101729 | SGgs | ND | HI | SGgs | SGgs | HI | ND | HI | ND | ND | SGgs | SN | ND | HI | SN | ND | SGgs |
|  | 101730 | TP | ND | HI | TP | TP | HI | ND | HI | ND | ND | TP | AK | ND | HI | AK | ND | TP |
|  | 101731 | IA | ND | HI | IA | IA | HI | ND | HI | ND | ND | IA | AK | ND | HI | AK | ND | IA |
|  | 101732 | VG | ND | HI | VG | VG | HI | ND | HI | ND | ND | VG | AK | ND | HI | AK | ND | VG |
|  | 101733 | SGgs | ND | HI | SGgs | SGgs | HI | ND | HI | ND | ND | SGgs | AK | ND | HI | AK | ND | SGgs |
|  | 101734 | TP | ND | HI | TP | TP | HI | ND | HI | ND | ND | TP | DH | ND | HI | DH | ND | TP |
|  | 101735 | IA | ND | HI | IA | IA | HI | ND | HI | ND | ND | IA | DH | ND | HI | DH | ND | IA |
|  | 101736 | VG | ND | HI | VG | VG | HI | ND | HI | ND | ND | VG | DH | ND | HI | DH | ND | VG |
|  | 101737 | SGgs | ND | HI | SGgs | SGgs | HI | ND | HI | ND | ND | SGgs | DH | ND | HI | DH | ND | SGgs |
|  | 101738 | TP | KD | KI | TP | TP | KI | KD | KI | KD | KD | TP | SN | KD | KI | SN | KD | TP |
|  | 101739 | IA | KD | KI | IA | IA | KI | KD | KI | KD | KD | IA | SN | KD | KI | SN | KD | IA |
|  | 101740 | TP | KD | KI | TP | TP | KI | KD | KI | KD | KD | TP | AK | KD | KI | AK | KD | TP |
|  | 101741 | IA | KD | KI | IA | IA | KI | KD | KI | KD | KD | IA | AK | KD | KI | AK | KD | IA |
| All typical | 101041 | NG | HD | NI | NG | NG | NI | HD | NI | HD | HD | NG | nNN | HD | NI | nNN | HD | NG |

TABLE 29B

Type substitutions

| | TALEN | T | C | A | T | T | A | C | A | C | C | T | G | C | A | G | C | T |
|---|---|---|---|---|---|---|---|---|---|---|---|---|---|---|---|---|---|---|
| Type | 101742 | NG | HD | HI | NG | NG | HI | HD | HI | HD | HD | NG | nNN | HD | HI | nNN | HD | NG |
|  | 101743 | NG | HD | KI | NG | NG | KI | HD | KI | HD | HD | NG | nNN | HD | KI | nNN | HD | NG |
|  | 101744 | NG | HD | RI | NG | NG | RI | HD | RI | HD | HD | NG | nNN | HD | RI | nNN | HD | NG |
|  | 101745 | NG | ND | NI | NG | NG | NI | ND | NI | ND | ND | NG | nNN | ND | NI | nNN | ND | NG |
|  | 101746 | NG | KD | NI | NG | NG | NI | KD | NI | KD | KD | NG | nNN | KD | NI | nNN | KD | NG |
|  | 101747 | NG | cND | NI | NG | NG | NI | cND | NI | cND | cND | NG | nNN | cND | NI | nNN | cND | NG |
|  | 101748 | NG | HD | NI | NG | NG | NI | HD | NI | HD | HD | NG | SN | HD | NI | SN | HD | NG |
|  | 101749 | NG | HD | NI | NG | NG | NI | HD | NI | HD | HD | NG | AK | HD | NI | AK | HD | NG |
|  | 101750 | NG | HD | NI | NG | NG | NI | HD | NI | HD | HD | NG | DH | HD | NI | DH | HD | NG |
|  | 101751 | NG | HD | NI | NG | NG | NI | HD | NI | HD | HD | NG | cHN | HD | NI | cHN | HD | NG |
|  | 101752 | NG | HD | NI | NG | NG | NI | HD | NI | HD | HD | NG | KN | HD | NI | KN | HD | NG |
|  | 101753 | TP | HD | NI | TP | TP | NI | HD | NI | HD | HD | TP | nNN | HD | NI | nNN | HD | TP |
|  | 101754 | IA | HD | NI | IA | IA | NI | HD | NI | HD | HD | IA | nNN | HD | NI | nNN | HD | IA |
|  | 101755 | VG | HD | NI | VG | VG | NI | HD | NI | HD | HD | VG | nNN | HD | NI | nNN | HD | VG |
|  | 101756 | SGgs | HD | NI | SGgs | SGgs | NI | HD | NI | HD | HD | SGgs | nNN | HD | NI | nNN | HD | SGgs |
|  | 101757 | IP | HD | NI | IP | IP | NI | HD | NI | HD | HD | IP | nNN | HD | NI | nNN | HD | IP |

TABLE 29C

Single RVD substitutions

| | TALEN | T | C | A | T | T | A | C | A | C | C | T | G | C | A | G | C | T |
|---|---|---|---|---|---|---|---|---|---|---|---|---|---|---|---|---|---|---|
| Single | 101758 | NG | HD | HI | NG | NG | NI | HD | NI | HD | HD | NG | nNN | HD | NI | nNN | HD | NG |
|  | 101759 | NG | HD | KI | NG | NG | NI | HD | NI | HD | HD | NG | nNN | HD | NI | nNN | HD | NG |
|  | 101760 | NG | HD | RI | NG | NG | NI | HD | NI | HD | HD | NG | nNN | HD | NI | nNN | HD | NG |
|  | 101761 | NG | ND | NI | NG | NG | NI | HD | NI | HD | HD | NG | nNN | HD | NI | nNN | HD | NG |
|  | 101762 | NG | KD | NI | NG | NG | NI | HD | NI | HD | HD | NG | nNN | HD | NI | nNN | HD | NG |
|  | 101763 | NG | cND | NI | NG | NG | NI | HD | NI | HD | HD | NG | nNN | HD | NI | nNN | HD | NG |
|  | 101764 | NG | HD | NI | NG | NG | NI | HD | NI | HD | HD | NG | SN | HD | NI | nNN | HD | NG |
|  | 101765 | NG | HD | NI | NG | NG | NI | HD | NI | HD | HD | NG | AK | HD | NI | nNN | HD | NG |
|  | 101766 | NG | HD | NI | NG | NG | NI | HD | NI | HD | HD | NG | DH | HD | NI | nNN | HD | NG |
|  | 101767 | NG | HD | NI | NG | NG | NI | HD | NI | HD | HD | NG | cHN | HD | NI | nNN | HD | NG |
|  | 101768 | NG | HD | NI | NG | NG | NI | HD | NI | HD | HD | NG | KN | HD | NI | nNN | HD | NG |
|  | 101769 | NG | HD | NI | NG | TP | NI | HD | NI | HD | HD | NG | nNN | HD | NI | nNN | HD | NG |

TABLE 29C-continued

Single RVD substitutions

|  |  |  |  |  |  |  |  |  |  |  |  |  |  |  |  |  |
|---|---|---|---|---|---|---|---|---|---|---|---|---|---|---|---|---|
|  | 101770 | NG | HD | NI | NG | IA | NI | HD | NI | HD | HD | NG | nNN | HD | NI | nNN | HD | NG |
|  | 101771 | NG | HD | NI | NG | VG | NI | HD | NI | HD | HD | NG | nNN | HD | NI | nNN | HD | NG |
|  | 101772 | NG | HD | NI | NG | SGgs | NI | HD | NI | HD | HD | NG | nNN | HD | NI | nNN | HD | NG |
|  | 101773 | NG | HD | NI | NG | IP | NI | HD | NI | HD | HD | NG | nNN | HD | NI | nNN | HD | NG |
| All typical | 101041 | NG | HD | NI | NG | NG | NI | HD | NI | HD | HD | NG | nNN | HD | NI | nNN | HD | NG |

These novel TALENs were then tested for cleavage activity against the endogenous CCR5 locus at 30 and 37 degrees, and analyzed by the Cel-I assay as described previously, and were shown to be active at inducing NHEJ (e.g. see FIG. 30). Note that the unlabeled lane represents a non-functional TALEN construct with a frame shift mutation.

The results show that the novel (atypical) RVDs are capable of cleaving DNA when in used in TALEN proteins in which each TALE-repeat unit includes a novel RVD, as well as in type substituted or singly substituted TALENs.

Example 16

Novel TALE C-Terminal Half Repeats

The majority of natural TALEs use the NG RVD in the C-terminal half repeat to specify interaction with a T nucleotide base. Thus, generation of novel C-terminal half repeats was investigated to allow for the expansion of TALE targeting. TALENs targeting the Pou5F1 and PITX3 genes were used as backbones, and the RVD within the C-terminal half repeat (C-cap amino acids C-9 and C-8) was altered to specify alternate nucleic acids. In these mutants, the NI RVD was inserted to recognize A, HD for C, NK for G and the control was NG for T. The TALENs used contained between 15 and 18 RVDs and targeted a variety of target sequences in these two genes.

The results are shown in FIG. 29 and demonstrate that the RVD position in the C-terminal half repeat can be engineered to interact with nucleotide bases other than only T, or can be designed to recognize all bases equally. The lane assignments, target sequences, and % NHEJ as measured in this Cel-I assay are shown below in Table 30.

TABLE 30

Novel C-terminal half repeat targets

| No. | SBS# | Target | Binding sequence | NHEJ % |
|---|---|---|---|---|
| 1 | 101124 | Pou5F1 | 5' GCAGCTGCCCAGACCT (SEQ ID NO: 185) | 2.2 |
|  | 101126 |  | 5' GACCCTGCCTGCT (SEQ ID NO: 186) |  |
| 2 | 101125 | Pou5F1 | 5' GACCCTGCCTGCTCCT (SEQ ID NO: 187) | 5.0 |
|  | 101225 |  | 5'CACCTGCAGCTGCCCAG (SEQ ID NO: 188) |  |
| 3 | 101139 | Pou5F1 | 5; GGGCTCTCCCATGCAT (SEQ ID NO: 189) | 6.7 |
|  | 101141 |  | 5'TCCTAGAAGGGCAGGC (SEQ ID NO: 190) |  |
| 4 | 101138 | Pou5F1 | 5'CTGGGCTCTCCCAT (SEQ ID NO: 191) | 25.6 |
|  | 101229 |  | 5'CCCCCATTCCTAGAAGG (SEQ ID NO: 192) |  |
| 5 | 101151 | Pitx3 | 5'CCGCACCCCCAGCT (SEQ ID NO: 193) | 13.3 |
|  | 101233 |  | 5'GCTCCTGGCCCTTGCA (SEQ ID NO: 194) |  |
| 6 | 101231 | Pitx3 | 5'GGCACTCCGCACCCCA (SEQ ID NO: 195) | 10.0 |
|  | 101234 |  | 5'ACCGCTGTGCTCCTGGC (SEQ ID NO: 196) |  |
| 7 | 101230 | Pitx3 | 5'GGCACTCCGCACCCC (SEQ ID NO: 197) | 4.9 |
|  | 101156 |  | 5'TACCGCTGTGCTCCT (SEQ ID NO: 198) |  |
| 8 | 101236 | Pitx3 | 5'ACGCCGTGGAAAGGCC (SEQ ID NO: 199) | 2.5 |
|  | 101237 |  | 5'CGGGGATGATCTACGG (SEQ ID NO: 200) |  |
| 9 | 101235 | Pitx3 | 5'ACGCCGTGGAAAGGC (SEQ ID NO: 201) | 8.1 |
|  | 101238 |  | 5'CGGGGATGATCTAC (SEQ ID NO: 202) |  |
| 10 | 101236 | Pitx3 | 5'ACGCCGTGGAAAGGCC (SEQ ID NO: 203) | 9.2 |
|  | 101238 |  | 5'CGGGGATGATCTAC (SEQ ID NO: 204) |  |
| 11 | 101167 | Pitx3 | 5'CGTTGCCCCCGCCCT (SEQ ID NO: 205) | 13.1 |
|  | 101239 |  | 5'ATGAGCGGCCCCGCC (SEQ ID NO: 206) |  |
| 12 | 101166 | Pitx3 | 5'GAGCGGCCCCGCCCGT (SEQ ID NO: 207) | 5.3 |
|  | 101167 |  | 5'CGTTGCCCCCGCCCT (SQ ID NO: 208) |  |
| 13 | 101239 | Pitx3 | 5'ATGAGCGGCCCCGCC (SEQ ID NO: 209) | 11.2 |
|  | 101240 |  | 5'GAATCGTTGCCCCCGC (SEQ ID NO: 210) |  |
| 14 | 101166 | Pitx3 | 5'GAGCGGCCCCGCCCGT (SEQ ID NO: 211) | 10.7 |
|  | 101240 |  | 5'GAATCGTTGCCCCCGC (SEQ ID NO: 212) |  |

This data demonstrates that TALENs with novel half repeats are capable of cleaving their respective targets.

Example 17

Identification of Optimal Target Sequences

To determine optimal target sequences, and thus optimal TALEN protein design, an in silico analysis was done using the results from multiple SELEX assays to determine i) the best target for the R1 repeat (N-terminal repeat) unit and ii) how specific RVD repeats behave in the context of their neighboring repeat units in dimer and trimer settings. In these studies, the NI RVD was used to recognize A, HD for C, NN for G, and NG for T.

Results are summarized in Tables 31, 32 and 33. The values in Table 31 are log-odds scores calculated as the logarithm (base 4) of the ratio between the observed frequency of the targeted base and the frequency of that base expected by chance (i.e. 0.25). A score of 1.0 would indicate that the targeted base was observed 100% of the time (i.e. 4 times more frequent than expected by chance), a score of 0.0 would indicate that the targeted base was observed 25% of the time, and a negative score, would indicate that the targeted base was observed less than 25% of the time. The values in Table 31 were calculated from the average base frequency for the appropriate positions of a data set consisting of SELEX data from 62 separate TALE proteins. The values labeled "R1 RVD" refer to the N-terminal TALE repeat (and cognate position in each binding site). The values labeled "R2+RVD) refer to all other RVDs (and cognate positions in each binding site). This data indicates a dramatic different in the specificity of TALE repeats bearing HD, NN, and NG RVDs at the N-terminal position versus all other positions.

The values shown in Tables 32 and 33 represent the change in those log-odds scores determined for each base independently versus the score in either the dimer (Table 32) or trimer (Table 33) setting and were determined from SELEX data for 67 separate TALE proteins. Thus the −0.12 value for an NN RVD adjacent to an HD RVD (with the NN RVD closer to the N-terminus of the construct and the HD RVD closer to the C-terminus of the construct) indicates that the sum of the log-odds scores for both positions in the dimer was 0.12 less than would be expected if these two RVDs behaved independently of each other. Similarly, the −0.34 value in Table 33C indicates that an NN RVD flanked on the N-terminal side by a second NN RVD and flanked on the C-terminal side by an HD RVD indicates that the NN RVD of interest has a log-odds score 0.34 less than the average value for all NN RVDs. In Tables 32, 33A, 33B, 33C, and 33D, negative values indicate combinations of adjacent RVDs that perform more poorly than if they were completely independent of each other.

TABLE 31

Log-odds scores for RVD specificity at single positions

| R1 RVD | | R2 + RVD | |
|---|---|---|---|
| NI (A) | 0.87 | NI (A) | 0.88 |
| HD (C) | 0.39 | HD (C) | 0.89 |
| NN (G) | 0.42 | NN (G) | 0.71 |
| NG (T) | 0.31 | NG (T) | 0.85 |

TABLE 32

Change in log-odds scores for RVD specificity for two adjacent RVDs

| | RVD | C-terminal RVD → | | | |
|---|---|---|---|---|---|
| | | NI (A) | HD (C) | NN (G) | NG (T) |
| N-terminal RVD ↓ | NI (A) | 0.03 | 0.07 | −0.10 | 0.11 |
| | HD (C) | 0.04 | 0.04 | −0.05 | −0.04 |
| | NN (G) | 0.12 | −0.12 | −0.08 | 0.07 |
| | NG (T) | 0.07 | −0.10 | 0.15 | −0.20 |

TABLE 33A

Change in log-odds scores for RVD specificity in trimer positions, NI (A) in middle

| | RVD | C-terminal RVD → | | | |
|---|---|---|---|---|---|
| | | NI (A) | HD (C) | NN (G) | NG (T) |
| N-terminal RVD ↓ | NI (A) | *0.06* | 0.11 | −0.06 | 0.04 |
| | HD (C) | 0.03 | 0.00 | −0.06 | 0.02 |
| | NN (G) | −0.03 | 0.06 | −0.01 | 0.02 |
| | NG (T) | *−0.03* | 0.05 | *0.07* | −0.05 |

TABLE 33B

Change in log-odds scores for RVD specificity in trimer positions, HD (C) in middle

| | RVD | C-terminal RVD → | | | |
|---|---|---|---|---|---|
| | | NI (A) | HD (C) | NN (G) | NG (T) |
| N-terminal RVD ↓ | NI (A) | 0.02 | 0.03 | 0.06 | −0.01 |
| | HD (C) | 0.05 | 0.02 | *0.09* | 0.00 |
| | NN (G) | 0.07 | 0.04 | *0.07* | −0.01 |
| | NG (T) | 0.04 | −0.01 | *−0.51* | −0.17 |

TABLE 33C

Change in log-odds scores for RVD specificity in trimer positions, NN (G) in middle

| | RVD | C-terminal RVD → | | | |
|---|---|---|---|---|---|
| | | NI (A) | HD (C) | NN (G) | NG (T) |
| N-terminal RVD ↓ | NI (A) | 0.07 | −0.23 | 0.04 | −0.03 |
| | HD (C) | *0.20* | 0.04 | *0.20* | 0.09 |
| | NN (G) | −0.12 | −0.34 | 0.01 | −0.01 |
| | NG (T) | 0.15 | −0.17 | 0.13 | 0.12 |

TABLE 33D

Change in log-odds scores for RVD specificity in trimer positions, NG (T) in middle

| | RVD | C-terminal RVD → | | | |
|---|---|---|---|---|---|
| | | NI (A) | HD (C) | NN (G) | NG (T) |
| N-terminal RVD ↓ | NI (A) | 0.11 | 0.10 | 0.14 | 0.08 |
| | HD (C) | ND | −0.07 | 0.07 | −0.11 |
| | NN (G) | 0.09 | −0.12 | 0.05 | −0.01 |
| | NG (T) | 0.04 | −0.07 | −0.05 | −0.27 |

Note: in Tables 33A through 33D, italics indicate less than 3 values in the dataset, where all other numbers contain at least 3 values used for determining the probability changes.

These results demonstrate that there is context dependency for optimal repeat unit binding, and indicate that for optimal protein design/target identification, the repeat units are not completely modular. As a whole, these data can be used to propose design rules to optimize both the target selection for a particular TALE and for designing the optimal TALENs. For example, it appears that NI is the least context dependent RVD and the best RVD at the R1 position is NI (e.g. ideally target sites should start with TA to accommodate R0 and R1-NI). It appears that AC, AT, CC, CA, TA, AA are the best dimers to target while GG, GC, AG, TT, CG, GT, and TC are the worst. In terms of triplets, AAC, ATG, GCA, ATA, ACG, and ATC are very good triplets to target while GGC, AGC, TGC, TTT, GGA, AGT, GGT, GGG, TCT, GTC, CTT, and AGG appear to be the worst. Thus, these design rules can be combined to create the optimally binding TALENs. Similarly, SELEX studies with NK, AK, and DK RVDs in Table 28 and additional SELEX studies with NK RVDs (FIG. 17A) indicate that RVDs with lysine (K) at position 13 tend to cause adjacent NI RVDs C-terminal to the NK, AK, or DK RVD to specify G rather than A. Thus design rules determined for typical RVDs and the NK RVDs should also apply to atypical RVDs with the same residue at position 13.

Example 18

Demonstration of TALEN-Driven Targeted Integration in Human Stem Cells

To demonstrate the versatility of the TALEN system, TALENs were used to drive targeted integration in human embryonic stem cells (ESC) and induced pluripotent stem cells (iPSC). Human ESCs and iPSCs were used for the targeted integration of a puromycin donor nucleic acid additionally comprising a restriction site, into the AAVS1 locus where expression of the puromycin marker is driven by the AAVS1 promoter. Donors and methods followed were those described previously in co-owned WO2010117464 (see also Hockemeyer et al (2009) *Nat Biotechnol* 27(9): 851-857, in which we demonstrated that the spontaneous frequency of targeted integration of such a construct into the AAVS1 locus is below the limit of detection of our assay). Nucleases used were TALENs specific for the AAVS1 locus as described in Example 11, and the target binding site is shown below:

```
101077
TCCCCTCCACCCCACAGTggggccactagggacAGGATTGGTGACAGAAAA (SEQ ID NO: 213)
AGGGGAGGTGGGGTGTCAccccggtgatccctgTCCTAACCACTGTCTTTT (SEQ ID NO: 214)
                  101079
```

First, this locus was targeted with a gene trap approach in which the puromycin resistance gene (PURO) was expressed under the control of the endogenous PPP1R12C promoter only following a correct targeting event. Second, the PPP1R12C locus was targeted using an autonomous selection cassette that expressed the puromycin resistance gene PURO from the phosphoglycerate kinase (PGK) promoter. Clones of puromycin resistant cells were grown and screened by Southern blot against restricted DNA using standard methods. The probe used in this experiment was against the PPP1R12C/AAVS1 locus and recognized a sequence that is the small restriction fragment of DNA (and thus had a higher mobility) with incorporated donor. Targeting efficiency was high independent of the donor used, with approximately 50% of isolated clones possessing either heterozygous or homozygous correctly targeted events and carrying the transgene only at the desired locus. This efficiency is comparable to that previously observed with ZFNs. Targeting to the PPP1R12C locus resulted in expression of the introduced transgene. Uniform expression of enhanced green fluorescent protein (eGFP) was observed in hESCs and iPSC when targeted with the SA-PURO donor plasmids that additionally carries a constitutive eGFP expression cassette. Importantly, hESCs that have been genetically engineered using TALENs remained pluripotent as indicated by their expression of the pluripotency markers OCT4, NANOG, SSEA4, Tra-1-81 and Tra-1-60.

TALENs were also designed against the first intron of the human OCT4 gene (OCT4-Int1-TALEN) and the target sequence is shown below in combination with three different donor plasmids:

```
101125: GACCCTGCCTGCTCCT    (SEQ ID NO: 329)

101225: CACCTGCAGCTGCCCAG   (SEQ ID NO: 330)
```

The TALENs utilized a +63 C-cap and used the typical RVDs (NI, HD, NN, and NG to target A, C, G, and T respectively). 101125 comprised 15.5 TALE repeats and 101225 comprised 16.5 TALE repeats. 101225 utilized a half repeat with an NN RVD to recognize the 3' G in its target site.

Correct targeting events are characterized by expression of both puromycin and an OCT4 exon1-eGFP fusion protein under control of the endogenous OCT4 promoter. The first two donor plasmids were designed to integrate a splice, acceptor eGFP-2A-self-cleaving peptide (2A)-puromycin cassette into the first intron of OCT4, and differed solely in the design of the homology arms, while the third donor was engineered to generate a direct fusion of exon 1 to the reading frame of the eGFP-2A-puromycin cassette. Both strategies resulted in correct targeted gene addition to the OCT4 locus as determined by Southern blot analysis and DNA sequencing of single-cell-derived clones. Targeting efficiencies ranged from 67% to 100% in both hESCs and iPSCs.

To test whether TALENs can be used to genetically engineer loci that are not expressed in hESCs, TALENs were engineered (using the same design and assembly procedure used for 101125 and 101225) to cleave within the first coding exon of the PITX3 gene. The target sequences are shown below:

```
101148: GGCCCTTGCAGCCGT     (SEQ ID NO: 331)

101146: CAGACGCTGGCACT      (SEQ ID NO: 332)
```

After electroporation, targeting events were evaluated by Southern blot analysis using an external 5' and an internal 3' probe. Single-cell-derived clones carrying the donor-specified eGFP transgene solely at PITX3 were obtained on average 6% of the time. Of note, one of 96 hESC clones analyzed carried the transgene on both alleles of PITX3 Exon1 (in WI#3) hESCs demonstrating the successful genetic modification of both alleles of a non-expressed gene in a single step.

These results demonstrate the ability to use TALENs to drive targeted integration into the genome of stem cells.

Example 19

Examples of TALEN Mediated Gene Editing In Vivo

TALEN genome editing in *C. elegans*. To demonstrate that TALENs could be used in animals for in vivo gene editing, the following experiments were conducted. A TALEN pair specific for the *Caenorhabditis elegans* ben-1 mutation were delivered as RNA and screened for benomyl resistance as described in Driscoll et al ((1989) *J. Cell. Biol.* 109:2993-3003). The ben-1 mutant phenotype is dominant and visible in 100% of progeny under a regular dissecting microscope. Briefly, wild-type *C. elegans* hermaphrodites were reared on regular NGM agar plates before injection with mRNAs encoding TALENs targeting ben-1.

The nucleic acids encoding the TALENs were inserted into an SP6 in vitro transcription vector (IVT) using standard restriction cloning procedures. The ICT vector backbone was derived from pJK370 and contains 5' and 3' UTR sequences shown previously to support germ-line translation (see Marin and Evans (2003) *Development* 130: 2623-2632). Production of mRNAs containing 5' CAP structures and poly A was performed in vitro using the mMessage mMachine® (Ambion) and polyA tailing kits (Ambion) and purified over a Ambion MEGAClear™ column prior to quantitation using a NanoDrop spectrophotometer (Thermoscientific). mRNA injections were performed under a Zeiss Axiovert microscope using a Narishige IM300 injector. Injection of mRNAs were performed according to standard *C. elegans* DNA injection protocols (see Stinchcomb et al. (1985) *Mol Cell Biol* 5:3484-3496) with the following differences: the regulator was adjusted such that the pressure from the N2 gas tank was 60 psi. The $P_{inject}$ and $P_{balance}$ measurements were adjusted to 15 psi and 2 psi, respectively. These pressure values are lower than those typically used for DNA injections to allow a more gentle release of fluid into the worm gonad. All mRNAs were injected at 500 ng/µL, and all mRNAs encoding the TALENs were injected as pairs, thus the total mRNA concentration in the needle was 1000 ng/µL.

Following mRNA injection, the animals were transferred to plates containing 7 µM benomyl. F1 self-progeny were screened as young adults by touching the anterior side of the animal. Heterozygous mutant animals respond by reversal using multiple sinusoidal-like movements, whereas wild-type animals are paralyzed and lack this ability. Non-paralyzed F1 animals were either lysed individually for PCR/Cel-I analysis of the target site (as described above), or transferred individually to fresh benomyl plates and homozygotes isolated from non paralyzed F2 by sequencing over the target site. One TALEN pair, designated 101318/101321, caused reversion of the ben-1 mutation phenotype, and the F1 progeny were found to be resistant to benomyl. Sequence analysis of the benomyl resistant animals revealed two different bona fide indels at the target location. The locus in the target site for this TALEN pair is shown below, and their sequences are shown in Example 23.

```
       101318
       TCCAGCCTGATGGAACttataagggagaaagtgATTTGCAGTTGGAAAGAA  (SEQ ID NO: 215)
       AGGTCGGACTACCTTGaatattccctctttcacTAAACGTCAACCTTTCTT  (SEQ ID NO: 216)
                                                                       101321
```

These data demonstrate that TALENs are capable of genomic editing in vivo.

TALEN genome editing in rats. Next, TALENs were used to edit the rat genome. The rat IgM-specific TALEN pair 101187/101188 that targets Exon 2 in the endogenous rat IgM gene was constructed as previously described in Examples 11 and 12 above. The target sequence in the rat genome is shown below where the bold and upper case letters indicate the target site for the TALE DNA binding domain and the lowercase letters indicate the gap or spacer region:

```
       101187SEQ ID 380: 5'-
       TTCCTGCCCAGCTCCATttccttctcctggaactACCAGAACAACACTGAA -3'
       SEQ ID 381: 3'- AAGGACGGGTCGAGGTAaaggaagaggaccttgaTGGTCTTGTTGTGACTT -5'
                                                                        101188
```

Nucleic acids encoding these TALEN pair were then injected into rat embryos as described in Menoret et al (2010) *Eur J Immunol*. October; 40(10): 2932-41. Nucleic acids encoding the TALENs were injected either as a pronuclear (PNI, DNA) or an intracytoplasmic (IC, RNA) injection at the doses shown below in Table 35.

TABLE 34

Route and Dose of rat IgM-specific TALENs

| Strain | Target/Construct | Route/Dose (ng/µl) | No. Injected embryos | No. Transfered embryos | Injected/ Transfered (%) | No. pups | No. founders | No. mutant founders |
|---|---|---|---|---|---|---|---|---|
| SD | IgM/TALEs | PNI/10 | 166 | 98 | 59.04 | 13 | 13 | 3 |
| SD | IgM/TALEs | PNI/2 | 236 | 150 | 63.56 | 53 | 53 | 4 |
| SD | IgM/TALEs | PNI/0.4 | 84 | 59 | 70.24 | 3 + 6 transferred mothers* | ND | ND |
| SD | IgM/TALEs | IC/10 | 200 | 141 | 70.5 | 6 transferred mothers* | ND | ND |
| SD | IgM/TALEs | IC/4 | 187 | 122 | 65.2 | 7 transferred mothers* | ND | ND |

TABLE 34-continued

Route and Dose of rat IgM-specific TALENs

| Strain | Target/Construct | Route/Dose (ng/μl) | No. Injected embryos | No. Transfered embryos | Injected/ Transfered (%) | No. pups | No. founders | No. mutant founders |
|---|---|---|---|---|---|---|---|---|
| SD | IgM/TALEs | IC/0.8 | 184 | 143 | 77.7 | 6 transferred mothers* | ND | ND |

*Note: not all expectant mothers had delivered, ND = not determined

A percentage of the injected embryos were implanted into pseudo pregnant female rats and resultant newborns were assayed for genome editing. DNA was isolated from the pups resulting from the pronuclear DNA injections and subjected to a T7 mismatch analysis as described in Kim et al (2009) Genome Res. 19(7): 1279-1288. Briefly, PCR was performed using the primer set GJC153F-154R to create a 371 bp PCR product. The primer pair is shown below:

```
GJC 153F primer:
                      (SEQ ID NO: 453)
5' ggaggcaagaagatggattc GJC 154R primer:
                      (SEQ ID NO: 454)
5' gaatcggcacatgcagatct
```

For this analysis, 100 ng tail gDNA was used which had been isolated by standard practice. Potential heteroduplexes were allowed to form using 5 ul of the PCR product as follows: 2' at 95° C./95° C. to 85° C. (−2° C./sec)/85° C. to 25° C. (−0.1° C./sec)/4° C. This was then digested with T7 endonuclease I (NEBiolabs ref: M0302L) under the following conditions: 5 ul PCR heteroduplex+1 ul 10×NEB2+0.5 ul T7 endo+3.5 ul H2O/20' a 37° C. Following digestion, the reaction was run on a 1.2% agarose gel in 0.5×TAE. 7 of the 66 pups analyzed were positive for NHEJ activity by the T7 assay, (shown in FIG. 31) and sequencing revealed the presence of a NHEJ associated indels (e.g. 1 bp deletion in rat 3.3 and a 90 bp deletion in rat 3.4).

TALEN pairs are also used for targeted integration with a nucleic acid of interest into rat cells to generate transgenic animals. The rat cells targeted by the TALEN pair are rat embryonic stem cells, one- or more-celled GFP-containing rat embryos or any rat cell type convertible to an induced pluripotent stem (iPS) cell. The TALEN pair is delivered to the cell and can be plasmid DNA, optimally containing a CAG promoter, mRNA, optimally with a 5' cap structure and a 3' poly-adenosine tail, purified protein or viral particles containing nucleic acid encoding the TALEN open reading frames. The donor DNA can single- or double-stranded circular plasmid DNA containing 50-1000 bp of homology on both sides of the break site or single- or double-stranded linear plasmid DNA containing 50-1000 bp of homology on both sides of the break site. The TALEN and donor are delivered by microinjection of rat cells or embryos, transfection of rat cells via electroporation, lipid-based membrane fusion, calcium phosphate precipitation, PEI, etc., incubation with purified nuclease protein (for example, if fused to a cell-penetrating peptide), or infection of rat cells or embryos with a virus. These methods are known in the art. The means of generating a modified rat from the injected or transfected cells or embryos will depend on the delivery method chosen. For embryos, the embryos will be implanted into the uterus of a pseudo-pregnant rat and allowed to come to term as described previously. For modified cells, three methods are possible: a) if the rat cells are embryonic stem cells, rat blastocysts should be injected with the modified rat stem cells. Blastocysts will be implanted into the uterus of a pseudo-pregnant rat and allowed to come to term; b) the cell (or its nucleus) should be microinjected into an enucleated oocyte (somatic cell nuclear transfer) and the resulting embryo implanted into the uterus of a pseudo-pregnant rat and allowed to come to term or c) the cell should be converted to an iPS cell and should be injected into a rat blastocyst. Blastocysts will be implanted into the uterus of a pseudo-pregnant rat and allowed to come to term. Pups are then assayed for presence of the transgene by PCR or any other means known in the art.

TALEN genome editing in plants. TALEN pairs specific for the Z. maize RPD1 and C1 genes were constructed as described above in Example 11 and their target sequences are shown below in comparison with the RPD1 locus (SEQ ID NOs: 382 through 387and 465, respectively, in order of appearance):

```
               TTATTTGAAGAAACTAT                (101389)
               TTATTTGAAGAAACT                  (101388)
                  TTTGAAGAACTATATT              (101390)
               TTATTTGAAGAAACTATATTACAGAGCATAAGCTTATGCAACACTCCCACTAGTTGATT
               AATAAACTTCTTTGATATAATGTCTCGTATTCGAATACGTTGTGAGGGTGATCAACTAA
                                                TACGTTGTGAGGGT            (101391)
                                                   TTGTGAGGGTGATCAAGT     (101393)
```

TALEN pairs made against the C1 locus are similarly shown below, (SEQ ID NOs: 388 through 390and 466, respectively, in order of appearance):

```
               TGGGGAGGAGGGCGTGCT                          (101370)
               TGGGGAGGAGGGCGTGCTGCGCGAAGGAAGGCGTTAAGAGAGGGGCGTGGACGAGCAAGG
               ACCCCTCCTCCCGCACGACGCGCTTCCTTCCGCAATTCTCTCCCCGCACCTGCTCGTTCC
                                                     TCTCTCCCCGCACCTGCT (101371)
```

Additional TALEN pairs were made against the C1 locus as follows, (SEQ ID NOs: 391 through 398):

```
TGAACTACCTCCGGCCC                                                    (101378)
                                        TCCTACGACGAGGAGGAT           (101380)
CTGAACTACCTCCGGCCCAACATCAGGCGCGGCAACATCTCCTACGACGAGGAGGATCTCATGATCATCCGCCT
GACTTGATGGAGGCCGGGTTGTAGTCCGCGCCGTTGTAGAGGATGCTGCTCCTCCTAGAGTACTAGTAGGCGGA
                                        TAGAGGATGCTGCTCCT           (101379)
CCACAGGCTCCTCGGCAACAGGT
GGTGTCCGAGGAGCCGTTCTCCA
   TGTCCGAGGAGCCGTT         (101381)
```

The plant specific TALEN pairs were analyzed in mammalian Neuro 2A cells for activity using the Dual-Luciferase Single Strand Annealing Assay (DLSSA). This is a novel system used to quantify ZFN or TALEN activities in transiently transfected cells, and is based on the Dual-Luciferase Reporter® Assay System from Promega. See, Example 13. The system allows for sequential measurement of two individual reporter enzymes, Firefly and Renilla Luciferases, within a single tube (well). Both of the Firefly and the Renilla Luciferase reporters are re-engineered and the assay conditions are optimized. The Firefly Luciferase reporter construct contains two incomplete copies of the Firefly coding regions that are separated by DNA binding sites for either ZFNs or TALENs. In this study, the 5' copy is derived from approximately two third of the N-terminal part of the Firefly gene and the 3' copy is derived from approximately two third of the C-terminal part of the Firefly gene. The two incomplete copies contain about 600-bp homology arms. The separated Firefly fragments have no luciferase activity. A DNA double strand break caused by a ZFN or TALEN pair will stimulate recombination between flanking repeats by the single-strand annealing pathway and then restore the Firefly luciferase function. The co-transfected Renilla Luciferase plasmid provides an internal control. The luminescent activity of each reporter is read on a luminometer. Normalizing the activity of the experimental reporter (Firefly) to the activity of the internal control (Renilla) minimizes experimental variability caused by differences in cell viability and/or transfection efficiency. The normalized value is used to determine the activity of a given ZFN or TALEN pair. This is a useful tool when working in systems with precious model cells or when the intended target cell type is either not available or difficult to be used for screening purpose. This is also useful tool to develop and to optimize TALEN technology platform when the target sequences are not available in endogenous genome. Active nucleases can be identified by DLSSA and then ported into the endogenous system for final evaluation. The active TALEN pairs on the plant targets are shown below in Table 35A.

TABLE 35A

| Plant TALENs | | | | |
|---|---|---|---|---|
| PAIR | TARGET | T1 | T2 | Activity* |
| 1 | C1 | 101370 | 101371 | 5.0 |
| 2 | C1 | 101378 | 101379 | 7.1 |

TABLE 35A-continued

| Plant TALENs | | | | |
|---|---|---|---|---|
| PAIR | TARGET | T1 | T2 | Activity* |
| 3 | C1 | 101380 | 101381 | 10.3 |
| 4 | RPD1 | 101388 | 101391 | 7.6 |
| 5 | RPD1 | 101389 | 101391 | 7.2 |
| 6 | RPD1 | 101389 | 101393 | 9.9 |
| 7 | RPD1 | 101390 | 101391 | 9.7 |
| 8 | RPD1 | 101390 | 101393 | 9.6 |
| Control | CCR5 | 41 | 47 | 12.0 |
| Control | pVax | | | 0.2 |

*Note:
Activity in this assay is measured in relative units in the luciferase SSA assay.

The TALEN pairs were then delivered via gold-particle bombardment to maize Hi II embryos using standard methods (Frame et al, (2000) *In vitro cellular & developmental biology*. 36(1): 21-29). In total, approximately 90 pollinated maize embryos per TALEN pair were transformed and allowed to grow for ca. seven days on callus initiation media prior to pooling and freezing in liquid N2 for genomic DNA extraction. Genomic DNA was isolated from 4-6 frozen embryos per bombarded plate using the DNeasy Plant Miniprep kit (Qiagen). Each TALEN target was then amplified by two-step PCR using High-Fidelity Phusion Hot Start II Polymerase (NEB) from pooled genomic DNA consisting of three biological triplicates. In the first round, each site was amplified in a 20-cycle PCR using 400 ng genomic DNA and the primers listed in Table 35B. In the second round, an additional 20 cycles were performed using 1 ul of product from the first PCR round and the primers SOLEXA-OUT-F1 and SOLEXA-OUT-R1 to generate complete Illumina sequencing amplicons. The resulting PCR products were then purified on Qiaquick PCR Purification columns (Qiagen), normalized to 50 nM each, and combined in equal volumes so that a total of eight sites were sequenced in a single Illumina lane. Control amplicons from untreated genomic DNA were submitted in a separate lane. Illumina single-read 100 bp sequencing was performed at ELIM Biopharmaceuticals (Hayward, Calif.).

TABLE 35B

Sequences of oligonucleotide primers used for Illumina sequencing

C1.70-71.F1  CTACACTCTTTCCCTACACGACGCTCTTCCGATCTggagcttgatcgacgaga (SEQ ID NO: 426)

TABLE 35B-continued

Sequences of oligonucleotide primers used for Illumina sequencing

| Name | Sequence |
|---|---|
| C1.78-79.F2 | CTACACTCTTTCCCTACACGACGCTCTTCCGATCTctgtggaggcggatgat (SEQ ID NO: 427) |
| C1.80-81.F1 | CTACACTCTTTCCCTACACGACGCTCTTCCGATCTactacctccggcccaac (SEQ ID NO: 428) |
| RPD1.88.91.F1 | CTACACTCTTTCCCTACACGACGCTCTTCCGATCTGGCCgctgcagactctatctcacc (SEQ ID NO: 429) |
| RPD1.89.91.F1 | CTACACTCTTTCCCTACACGACGCTCTTCCGATCTTTCCgctgcagactctatctcacc (SEQ ID NO: 430) |
| RPD1.89.93.F1 | CTACACTCTTTCCCTACACGACGCTCTTCCGATCTCCGGgctgcagactctatctcacc (SEQ ID NO: 431) |
| RPD1.90.91.F1 | CTACACTCTTTCCCTACACGACGCTCTTCCGATCTAACCgctgcagactctatctcacc (SEQ ID NO: 432) |
| RPD1.90.93.F1 | CTACACTCTTTCCCTACACGACGCTCTTCCGATCTCCAAgctgcagactctatctcacc (SEQ ID NO: 433) |
| C1.70-71.R1 | CAAGCAGAAGACGGCATACGAGCTCTTCCGATCTttccctccatttgccttc (SEQ ID NO: 434) |
| C1.78-79.R2 | CAAGCAGAAGACGGCATACGAGCTCTTCCGATCTgtgtgtgggtgcaggttt (SEQ ID NO: 435) |
| C1.80-81.R1 | CAAGCAGAAGACGGCATACGAGCTCTTCCGATCTcgtcgtcagctcgtgta (SEQ ID NO: 436) |
| RPD1.88.91.R1 | CAAGCAGAAGACGGCATACGAGCTCTTCCGATCTtgccaggaacactttcca (SEQ ID NO: 437) |
| RPD1.89.91.R1 | CAAGCAGAAGACGGCATACGAGCTCTTCCGATCTtgccaggaacactttcca (SEQ ID NO: 438) |
| RPD1.89.93.R1 | CAAGCAGAAGACGGCATACGAGCTCTTCCGATCTtgccaggaacactttcca (SEQ ID NO: 439) |
| RPD1.90.91.R1 | CAAGCAGAAGACGGCATACGAGCTCTTCCGATCTtgccaggaacactttcca (SEQ ID NO: 440) |
| RPD1.90.93.R1 | CAAGCAGAAGACGGCATACGAGCTCTTCCGATCTtgccaggaacactttcca (SEQ ID NO: 441) |
| SOLEXA-OUT-F1 | AATGATACGGCGACCACCGAGATCTACACTCTTTCCCTACACG (SEQ ID NO: 442) |
| SOLEXA-OUT-R1 | CAAGCAGAAGACGGCATA (SEQ ID NO: 443) |

The sequencing revealed the presence of numerous indels in the cell pools from the TALEN treated embryos as is shown below in Table 36. The details of the sequence analysis are as follows: barcoded sequences derived from TALEN treated Zea maize embryos were pooled together and submitted for 100 bp read-length sequencing on an Illumina GA2 sequencer. Barcoded sequences derived from mock treated Zea maize embryos were pooled together and submitted for 100 bp read-length sequencing on a separate lane of the same Illumina GA2 sequencer. Sequences in each resultant data file were separated by barcode and aligned against the unmodified genomic sequence. A small fraction of the embryos contained a 3 bp insertion in the C1 gene relative to the majority of the embryos. Indels consisting of at least 2 contiguous inserted or deleted bases within a 10 bp window centered on the expected TALEN cleavage sites were considered potential NHEJ events and were processed further. InDels that occurred with similar frequency in both a given TALEN treated sample and the cognate mock treated sample were considered sequencing artifacts and were discarded.

TABLE 36

InDels in TALEN treated maize

| | Target gene | TALEN pair | TALEN treated | | | Mock Treated | | |
|---|---|---|---|---|---|---|---|---|
| | | | Total reads | InDel | % InDel | Total reads | InDel | % InDel |
| S1 | C1 | 101370/101371 | 2033338 | 185 | 0.0091 | 1377048 | 0 | 0.0000 |
| S2 | C1 | 101378/101379 | 2208608 | 228 | 0.0103 | 2332142 | 2 | 0.0001 |

TABLE 36-continued

InDels in TALEN treated maize

| | Target gene | TALEN pair | TALEN treated | | | Mock Treated | | |
|---|---|---|---|---|---|---|---|---|
| | | | Total reads | InDel | % InDel | Total reads | InDel | % InDel |
| S3 | C1 | 101380/101381 | 2213631 | 360 | 0.0163 | 2020763 | 1 | 0.0000 |
| S4 | RPD1 | 101388/101391 | 2798647 | 341 | 0.0122 | 2679554 | 3 | 0.0001 |
| S5 | RPD1 | 101389/101391 | 2823653 | 414 | 0.0147 | 2549110 | 0 | 0.0000 |
| S6 | RPD1 | 101389/101393 | 2740241 | 239 | 0.0087 | 2783422 | 3 | 0.0001 |
| S7 | RPD1 | 101390/101391 | 2826655 | 495 | 0.0175 | 2790561 | 0 | 0.0000 |
| S8 | RPD1 | 101390/101393 | 2601239 | 482 | 0.0185 | 2910777 | 0 | 0.0000 |

Table 37 shows the most observed indels in the eight samples shown above, demonstrating that the TALENs were capable of inducing NHEJ with both gene targets and all pairs of nucleases. For each sample, the unaltered genomic sequence is shown with the gap between the two TALEN binding sites underlined. Deleted bases are indicated by colons and inserted bases are indicated by curved brackets with "{" indicating the start of the inserted sequence and "}" indicating the end of the inserted sequence.

TABLE 37

InDels observed in maize samples

S1 TALEN Treated (Gene Target: C1, TALEN pair 101370/101371)
GAGCGCGATGGGGAGGAGGGCGTGCT<u>GCGCGAAGGAAGGCGTT</u>AAGAGAGGGGCGTGGACGAGCAAGGAG

GAGCGCGATGGGGAGGAGGGCGTGCTGCGCGA::::::CGTTAAGAGAGGGGCGTGGACGAGCAAGGAG

GAGCGCGATGGGGAGGAGGGCGTGCTGCGCGAAGGA::GCGTTAAGAGAGGGGCGTGGACGAGCAAGGAG

GAGCGCGATGGGGAGGAGGGCGTGCTGCGCGAA:::AGGCGTTAAGAGAGGGGCGTGGACGAGCAAGGAG

GAGCGCGATGGGGAGGAGGGCGTGCTGCGCGA::::GGCGTTAAGAGAGGGGCGTGGACGAGCAAGGAG

GAGCGCGATGGGGAGGAGGGCGTGCTGtGCGA:::AAGGCGTTAAGAGAGGGGCGTGGACGAGCAAGGAG

GAGCGCGATGGGGAGGAGGGCGTGCTGCGCGAAGG::::CGTTAAGAGAGGGGCGTGGACGAGCAAGGAG

GAGCGCGATGGGGAGGAGGGCGTGCaGCGCG:::::AGGCGTTAAGAGAGGGGCGTGGACGAGCAAGGAG

GAGCGCGATGGGG:::::::::::::::AGGAAGGCGTTAAGAGAGGGGCGTGGACGAGCAAGGAG

S2 TALEN Treated (Gene Target: C1, TALEN pair 101378/101379)
GAGATCCTCCTCGTCGTAGGAGAT<u>GTTGCCGCGCCTGATGTT</u>GGGCCGGAGGTAGTTCAGCCACCGCAGC

GAGATCCTCCTCGTCGTAGGA:::::::::::::GATGTTGGGCCGGAGGTAGTTCAGCCACCGCAGC

GAGATCCTCCTCGTCGTAGGAGATGTTG::::::CTGATGTTGGGCCGGAGGTAGTTCAGCCACCGCAGC

GAGATCCTCCTCGTCGTAGGAGATGTTGC::CGCCTGATGTTGGGCCGGAGGTAGTTCAGCCACCGCAGC

GAGATCCTCCTCGTCGTAGGAGATGTTGCCGC::CTGATGTTGGGCCGGAGGTAGTTCAGCCACCGCAGC

GAGATCCTCCTCGTCGTAGGAGATGTTGC::::::TGATGTTGGGCCGGgGGTAGTTCAGCCACCGCAGC

GAGATCCTCCTCGTCGTAGGAGATGTTG:::::::::::::GGCCGGAGGTAGTTCAGCCACCGCAGC

GAGATCCTCCTCGTCGTAGGAGATGTTGCCGCG::::ATGTTGGGCCGGAGGTAGTTCAGCCACCGCAGC

GAGATCCTCCTCGTCGTAGGAGATGTT:::::GCCTGATGTTGGGCCGGAGGTAGTTCAGCCACCGCAGC

GAGATCCTCCTCGTCGTAGGAGATGTTGCC::::CTGATGTTGGGCCGGAGGTAGTTCAGCCACCGCAGC

GAGATCCTCCTCGTCGTAGGAGATGTTGCC::::::GATGTTGGGCCGGAGGTAGTTCAGCCACCGCAGC

S3 TALEN Treated (Gene Target: C1, TALEN pair 101380/101381)
GGCAACATCTCCTACGACGAGGAGGAT<u>CTCATCATCCGCCTCC</u>ACAGGCTCCTCGGCAACAGGTCGGTGC

GGCAACATCTCCTACGACGAGGAGGATCTCATC:::::CCTCCACAGGCTCCTCGGCAACAGGTCGGTGC

GGCAACATCTCCTACGACGAGGAGGATCTCATC::::GCCTCCACAGGCTCCTCGGCAACAGGTCGGTGC

TABLE 37-continued

InDels observed in maize samples

S4 TALEN Treated (Gene Target: RPD1, TALEN pair 101388/101391)
CTCGGAAGTTATTTGAAGAAACTA<u>TATATTACAGAGCATAAGCTT</u>ATGCAACACTCCCACTAGTTCATTTTT

CTCGGAAGTTATTTGAAGAAACTATATTACAGAGCATA{TA}AGCTTATGCAACACTCCCACTAGTTCATTTTT

CTCGGAAGTTATTTGAAGAAACTATATTA::::::::AGCTTATGCAACACTCCCACTAGTTCATTTTT

CTCGGAAGTTATTTGAAGAAACTATATTACAGAGCA::AGCTTATGCAACACTCCCACTAGTTCATTTTT

CTCGGAAGTTATTTGAAGAAACTATATTACAG:::::::CTTATGCAACACTCCCACTAGTTCATTTTT

CTCGG:::::::::::::::::::::::::::::AAGCTTATGCAACACTCCCACTAGTTCATTTTT

CTCGGAAGTTATTTGAAGAAACTATAT:::::::::::::::::CAACACTCCCACTAGTTCATTTTT

CTCGGAAGTTATTTGAAGAAACTATATT:::::GC:::AGCTTATGCAACACTCCCACTAGTTCATTTTT

CTCGGAAGTg:::::::::::::::::::GCATAAGCTTATGCAACACTCCCACTAGTTCATTTTT

CTCGGAAGTTATTTGAAGAAACT:::::::::::::::::TATGCAACACTCCCACTAGTTCATTTTT

CTCGGAAGTTATTTGAAGAAACTATATTACAGAGCA::::::::::ACACTCCCACTAGTTCATTTTT

S5 TALEN Treated (Gene Target: RPD1, TALEN pair 101389/101391)
CTCGGAAGTTATTTGAAGAAACTATA<u>ATTACAGAGCATAAGCTT</u>ATGCAACACTCCCACTAGTTCATTTTT

CTCGGAAGTTATTTGAAGAAACTATATTACA:::::::AGCTTATGCAACACTCCCACTAGTTCATTTTT

CTCGGAAGTTATTTGAAGAAACTATATTACAGA:::::AGCTTATGCAACACTCCCACTAGTTCATTTTT

CTCGGAAGTTATTTGAAGAAACTATATTACAGAGC::::::TTATGCAACACTCCCACTAGTTCATTTTT

CTCGGAAGTTATTTGAAGAAACTATATTACAG::CATAAGCTTATGCAACACTCCCACTAGTTCATTTTT

CTCGGAAGTTATTTGAAGAAACTATATTACAG::::TAAGCTTATGCAACACTCCCACTAGTTCATTTTT

CTCGGAAGTTATTTGAAGAAACTATATTAC::::::TAAGCTTATGCAACACTCCCACTAGTTCATTTTT

CTCGGAAGTTATTTGAAGAAACTATATTACA::::::AAGCTTATGCAACACTCCCACTAGTTCATTTTT

CTCGGAAGTTATTTGAAGAAACTATATTACAGA:::TAAGCTTATGCAACACTCCCACTAGTTCATTTTT

CTCGG::::::::::::::::::::::::::::::AAGCTTATGCAACACTCCCACTAGTTCATTTTT

CTCGGAAGTTATTTGAAGAAACTATATTAa:::::::AAGCTTATGCAACACTCCCACTAGTTCATTTTT

S6 TALEN Treated (Gene Target: RPD1, TALEN pair 101389/101393)
CTCGGAAGTTATTTGAAGAAACTATA<u>ATTACAGAGCATAAGCTTATGC</u>AACACTCCCACTAGTTCATTTTT CTCGGAAGTTATTTGAAGAAACTATATTACCc:::::::::::ATGCAACACTCCCACTAGTTCATTTTT

CTCGGAAGTTATTTGAAGAAACTATATT::::::::::::TATGCAACACTCCCACTAGTTCATTTTT

CTCGGAAGTTATTTGAAGAAACTATATTAC::::::::::CTTATGCAACACTCCCACTAGTTCATTTTT

CTCGGAAGTTATTTGAAGAAACTATAT:::::::::::::::GCAACACTCCCACTAGTTCATTTTT

CTCGGAAGTTATTTGAAGAAACTATATTA::::::::::::::TGCAACACTCCCACTAGTTCATTTTT

CTCGGAAGTTATTTGAAGAAACTATATTACA:::::::::::TATGCAACACTCCCACTAGTTCATTTTT

CTCGGAAGTTATTTGAAGAAACTATATTACAGAGCATA::CTTATGCAACACTCCCACTAGTTCATTTTT

CTCGGAAGTTATTTGAAGAAACTATATTACAGA:::::::::TGCAACACTCCCACTAGTTCATTTTT

CTCGGAAGTTATTTGAAGAAACTATATTACAGAGCATA:::TTATGCAACACTCCCACTAGTTCATTTTT

CTCGGAAGTTATTTGAAGAAACTATATTACAa:::::::::TATGCAACACTCCCACTAGTTCATTTTT

S7 TALEN Treated (Gene Target: RPD1, TALEN pair 101390/101391)
CTCGGAAGTTATTTGAAGAAACTATATT<u>ACAGAGCATAAGCTT</u>ATGCAACACTCCCACTAGTTCATTTTT

CTCGGAAGTTATTTGAAGAAACTATATTACAGAG::::AGCTTATGCAACACTCCCACTAGTTCATTTTT

CTCGGAAGTTATTTGAAGAAACTATATTACAGA:::::AGCTTATGCAACACTCCCACTAGTTCATTTTT

CTCGGAAGTTATTTGAAGAAACTATATTACAGAGC::::::TTATGCAACACTCCCACTAGTTCATTTTT

TABLE 37-continued

InDels observed in maize samples

```
CTCGGAAGTTATTTGAAGAAACTATATTACAGAG:::AAGCTTATGCAACACTCCCACTAGTTCATTTTT

CTCGGAAGTTATTTGAAGAAACTATATTACAGAGCA:::GCTTATGCAACACTCCCACTAGTTCATTTTT

CTCGGAAGTTATTTGAAGAAACTATATTACAGAGCA::AGCTTATGCAACACTCCCACTAGTTCATTTTT

CTCGGAAGTTATTTGAAGAAACTATATTACAGA:::AAGCTTATGCAACACTCCCACTAGTTCATTTTT

CTCGG::::::::::::::::::::::::::::AAGCTTATGCAACACTCCCACTAGTTCATTTTT

CTCGGAAGTTATTTGAAGAAACTATATTACAGAGC::::GCTTATGCAACACTCCCACTAGTTCATTTTT

CTCGGAAGTTATTTGAAGAAACTATATTACAGAG:::::GCTTATGCAACACTCCCACTAGTTCATTTTT

S8 TALEN Treated(Gene Target: RPD1, TALEN pair 101390/101393)
CTCGGAAGTTATTTGAAGAAACTATATTACAGAGCATAAGCTTATGCAACACTCCCACTAGTTCATTTTT

CTCGGAAGTTATTTGAAGAAACTATATTACAGAGC::::::TTATGCAACACTCCCACTAGTTCATTTTT

CTCGGAAGTTATTTGAAGAAACTATATTACAGAGCA::AGCTTATGCAACACTCCCACTAGTTCATTTTT

CTCGGAAGTTATTTGAAGAAACTATATTACAGAGCA:::GCTTATGCAACACTCCCACTAGTTCATTTTT

CTCGGAAGTTATTTGAAGAAACTATATTACAGAGC::::GCTTATGCAACACTCCCACTAGTTCATTTTT

CTCGGAAGTTATTTGAAGAAACTATATTACAGAGCA::::CTTATGCAACACTCCCACTAGTTCATTTTT

CTCGGAAGTTATTTGAAGAAACTATATTACAG::::::::::TATGCAACACTCCCACTAGTTCATTTTT

CTCGGAAGTTATTTGAAGAAACTATATTACAGAGC:::::::TATGCAACACTCCCACTAGTTCATTTTT

CTCGGAAGTTATTTGAAGAAACTATATTACAGA:::::::::TATGCAACACTCCCACTAGTTCATTTTT

CTCGGAAGTTATTTGAAGAAACTATATTA:::::::::::::TGCAACACTCCCACTAGTTCATTTTT

CTCGGAAGTTATTTGAAGAAACT::::::::::::::::::TATGCAACACTCCCACTAGTTCATTTTT
```

The InDel frequency was similar in all samples (from 0.0087% to 0.0185% or about 1 in 11,000 events to 1 in 5,400 events). This implies that the limiting factor is the biolistic delivery to the maize embryos rather than the TALEN activity. Barcoded sequences derived from TALEN treated *Zea maize* embryos were pooled together and submitted for 100 bp read-length sequencing on an Illumina GA2 sequencer.

Next, these TALENs are used to drive targeted integration (TI) of any desired DNA of interest into the DSB created by TALENs. TI can be accomplished in monocots or dicots using methods known in the art (see for example Shukla et al (2009) *Nature* 459:437 and Cai et al (2009) *Plant Mol Biol* 69:699). Novel plant species may also be generated stably transgenic for a selected TALEN as desired, allowing crossing of the TALEN strain to another in which a mutation is desired, followed by segregation of progeny such that some progeny contain only the desired mutation and the TALEN transgene has been segregated away.

Thus, these examples demonstrate that the novel TALENs of the invention are capable of genomic editing in vivo in plant and animal systems.

Example 21

Alterations of the TALE Repeat Unit

To explore alterations in the TALE repeat unit, sequence from both *Xanthomonas* and *Ralstonia* were compared. 52 unique repeat units from *Ralstonia* were examined to observe residue frequencies at each location, and then these values were compiled. The data are presented below in Table 38 where the amino acids are indicated in one letter code from left to the right and the position on the repeat unit is indicated from top to the bottom, and the RVD positions are indicated in bold:

TABLE 38

Frequencies of amino acids found in Ralstonia repeats

|    | A  | C | D  | E  | F | G  | H | I | K  | L  | M | N  | P | Q  | R | S  | T  | V  | W | Y |
|----|----|---|----|----|---|----|---|---|----|----|---|----|---|----|---|----|----|----|---|---|
| 1  |    |   |    |    |   |    |   |   |    | 52 |   |    |   |    |   |    |    |    |   |   |
| 2  |    | 1 |    |    |   |    |   |   |    |    |   | 7  |   |    |   | 40 | 4  |    |   |   |
| 3  |    |   |    |    |   |    | 2 |   |    |    |   | 4  |   |    |   | 45 | 1  |    |   |   |
| 4  | 25 |   |    | 24 |   |    |   |   |    |    |   |    | 3 |    |   |    |    |    |   |   |
| 5  |    |   |    |    |   |    |   |   |    |    |   | 52 |   |    |   |    |    |    |   |   |
| 6  |    |   |    |    |   |    |   | 1 |    | 3  |   |    |   |    |   |    |    | 48 |   |   |
| 7  | 1  |   |    |    |   |    |   |   |    |    |   |    |   |    |   |    |    | 51 |   |   |
| 8  | 50 |   |    |    |   |    |   |   |    |    |   |    |   |    |   |    | 2  |    |   |   |
| 9  |    |   |    |    |   | 44 |   |   |    |    |   |    |   |    |   |    |    |    |   | 8 |
| 11 |    |   |    |    |   | 1  |   |   |    |    |   |    |   |    |   | 51 |    |    |   |   |
| 12 |    |   |    |    |   | 1 |   |   | 25 |    |   |    |   | 18 |   | 2 | 6 |    |   |   |
| 10 | 52 |   |    |    |   |    |   |   |    |    |   |    |   |    |   |    |    |    |   |   |

TABLE 38-continued

Frequencies of amino acids found in Ralstonia repeats

| | A | C | D | E | F | G | H | I | K | L | M | N | P | Q | R | S | T | V | W | Y |
|---|---|---|---|---|---|---|---|---|---|---|---|---|---|---|---|---|---|---|---|---|
| 13 | | 12 | | | | 3 | 6 | 1 | 3 | | | 19 | 3 | | 2 | 2 | | | | 1 |
| 14 | | | | | | 52 | | | | | | | | | | | | | | |
| 15 | | | | | | 52 | | | | | | | | | | | | | | |
| 16 | | | | | | | | 50 | | | 1 | | | | 1 | | | | | |
| 17 | | | | | | | | | 1 | | | | | 9 | 41 | 1 | | | | |
| 18 | 52 | | | | | | | | | | | | | | | | | | | |
| 19 | | | | | | | | | | 52 | | | | | | | | | | |
| 20 | 1 | | | 51 | | | | | | | | | | | | | | | | |
| 21 | 47 | | | 2 | | 3 | | | | | | | | | | | | | | |
| 22 | | | | | | | 5 | | | | | | | | | | | 47 | | |
| 23 | | 1 | 1 | 2 | | 7 | | | 15 | | | | | | 17 | 1 | | 8 | | |
| 24 | 43 | | | 2 | | | | | 2 | 1 | | | | | | 1 | 3 | | | |
| 25 | | 4 | | | | 4 | | 7 | 10 | | | 2 | 25 | | | | | | | |
| 26 | | | | 8 | | | | | 43 | | | | | | | | | 1 | | |
| 27 | | | | | | | | | 21 | | | 19 | 1 | 8 | | | 3 | | | |
| 28 | 10 | | 13 | 8 | | 2 | | | 2 | | | | | | | 1 | | 16 | | |
| 29 | | | | | | | | | 51 | | | | | | | | | 1 | | |
| 30 | | | | | | | | | 1 | | | | | | 51 | | | | | |
| 31 | 27 | | | 21 | | | | | | | | | | | 2 | 2 | | | | |
| 32 | 42 | | | | | | | | | | | | | | | 3 | 7 | | | |
| 33 | | | | | | | | | | | | | | 51 | | | 1 | | | |
| 34 | | | | | | 2 | | | | | | | | | | | | | | 50 |
| 35 | 27 | | 3 | 5 | | 14 | | | | | | | | | | 1 | 1 | | 1 | |

These repeat units then can be combined with those from *Xanthamonas* to create unique repeat units. Repeat sequences that are combinations of residues found in Ralstonia repeats and residues found in *Xanthomonas* residues could yield proteins with improved properties such as increased DNA binding affinity, increased DNA binding specificity, or decreased sensitivity to oxidation. Examples of such repeat unit combinations include, with altered residues indicated in bold and a larger font size:

```
                                            (SEQ ID NO: 333)
LTPDQVVAIASHDGGKQALETVQRLLPVLCQDHG  Current
Xanthomonas (SEQ ID NO: 334)
LTPDQVVAIASHDGGKQALEAVRALLPVLCQDHG  Hybrid1

(SEQ ID NO: 335)
LTPDQVVAIASHDGGKQALEAVRAQLPVLCQDHG  Hybrid2

(SEQ ID NO: 336)
LTPDQVVAIASHDGGKQALEAVWALLPVLCQDHG  Hybrid3

(SEQ ID NO: 337)
LTPDQVVAIASHDGGKPALEAVWAKLPVLCQDHG  Hybrid4

(SEQ ID NO: 338)
LSTAQVVAIASHDGGKQALETVQRLLPVLCQDHG  Hybrid5

(SEQ ID NO: 339)
LTPDQVVAIASHDGGKQALEAVRALFPDLCQDHG  Hybrid6

(SEQ ID NO: 340)
LTPDQVVAIASHDGGKQALETVQRLLPVLRQDHG  Hybrid7

(SEQ ID NO: 341)
LSTAQVVAIASHDGGKQALEAVRAQLPVLRGAHG  Hybrid8
```

To explore this possibility, the repeat units shown below in Table 39 were constructed. The table shows a typical Ralstonia repeat unit on the first line, and a *Xanthomonas* repeat unit on the second. Novel repeats, containing both Ralstonia derived residues and other variations designed to probe the sequence requirements for TALE repeats, are shown on subsequent lines. All differences from the typical *Xanthomonas* repeat unit on the second line are underlined. Next, repeat units were engineered by varying the positions that are in bold in rows 3-27. These novel, engineered repeat units were then substituted into the system designed to test the novel RVDs in Example 15 and shown in FIG. 27, and the resultant constructs were translated in vitro and used in an ELISA. The target sequence used in the ELISA was the 'C' variant described in Example 15 (e.g. TTGACCATCC, SEQ ID NO:182) such that the RVD in all of these novel framework mutants was held constant at HD to interact with C. The ELISA results (average of 3 different experiments) are shown in Table 39 were all normalized to the standard sequence repeat unit sequence.

TABLE 39

Novel repeat framework substitutions

| Sequence | ELISA |
|---|---|
| LSTAQVVAIASHDGGKQALEAVRAQLLVLRAAPYA (SEQ ID NO: 74) | ND |
| LTPDQVVAIASHDGGKQALETVQRLLPVLCQDHG (SEQ ID NO: 333) | 1.00 |
| LTPDAVVAIASHDGGKQALETVQRLLPVLCQDHG (SEQ ID NO: 75) | 1.03 |
| LTPDQAVAIASHDGGKQALETVQRLLPVLCQDHG (SEQ ID NO: 76) | 0.89 |
| LTPDQVAAIASHDGGKQALETVQRLLPVLCQDHG (SEQ ID NO: 403) | 0.26 |
| LTPDQVVLIASHDGGKQALETVQRLLPVLCQDHG (SEQ ID NO: 404) | 0.73 |
| LTPDQVVTIASHDGGKQALETVQRLLPVLCQDHG (SEQ ID NO: 405) | 0.82 |
| LTPDQVVAASHDGGKQALETVQRLLPVLCQDHG (SEQ ID NO: 406) | 0.62 |
| LTPDQVVAVSHDGGKQALETVQRLLPVLCQDHG (SEQ ID NO: 407) | 0.76 |

TABLE 39-continued

Novel repeat framework substitutions

| Sequence | ELISA |
|---|---|
| LTPDQVVAILSHDGGKQALETVQRLLPVLCQDHG (SEQ ID NO: 408) | 0.25 |
| LTPDQVVAIAAHDGGKQALETVQRLLPVLCQDHG (SEQ ID NO: 409) | 0.90 |
| LTPDQVVAIASHDGGKQALATVQRLLPVLCQDHG (SEQ ID NO: 410) | 0.82 |
| LTPDQVVAIASHDGGKQALEAVQRLLPVLCQDHG (SEQ ID NO: 411) | 1.05 |
| LTPDQVVAIASHDGGKQALETAQRLLPVLCQDHG (SEQ ID NO: 412) | 0.70 |
| LTPDQVVAIASHDGGKQALETVARLLPVLCQDHG (SEQ ID NO: 413) | 0.91 |
| LTPDQVVAIASHDGGKQALETVRRLLPVLCQDHG (SEQ ID NO: 414) | 0.97 |
| LTPDQVVAIASHDGGKQALETVKRLLPVLCQDHG (SEQ ID NO: 415) | 0.92 |
| LTPDQVVAIASHDGGKQALETVWRLLPVLCQDHG (SEQ ID NO: 416) | 0.88 |
| LTPDQVVAIASHDGGKQALETVQALLPVLCQDHG (SEQ ID NO: 417) | 0.92 |
| LTPDQVVAIASHDGGKQALETVQRALPVLCQDHG (SEQ ID NO: 418) | 1.09 |
| LTPDQVVAIASHDGGKQALETVQRQLPVLCQDHG (SEQ ID NO: 419) | 0.90 |
| LTPDQVVAIASHDGGKQALETVQRLAPVLCQDHG (SEQ ID NO: 420) | 1.00 |
| LTPDQVVAIASHDGGKQALETVQRLLAVLCQDHG (SEQ ID NO: 421) | 1.21 |
| LTPDQVVAIASHDGGKQALETVQRLLLVLCQDHG (SEQ ID NO: 422) | 1.29 |
| LTPDQVVAIASHDGGKQALEAVRALLPVLCQDHG (SEQ ID NO: 423) | 1.42 |
| LSTAQVVAIASHDGGKQALETVQRLLPVLCQDHG (SEQ ID NO: 424) | 0.00 |
| LSTAQVVAIASHDGGKQALEAVRALLPVLCQDHG (SEQ ID NO: 425) | 0.00 |

As can be seen from the ELISA results, the activity of TALE DNA binding domains comprising an engineered (e.g., novel) framework with mutations in positions 2, 3, 4, 6, 7, 8, 9, 10 or 11 are diminished (with mutations in positions 2, 3, 4, 7, and 11 having the most significant effect on binding). In contrast, many of the substitutions in positions 20, 21, 24, 25, 26, and 27 either had a minimal effect on DNA binding or actually increased DNA binding. The largest increases in binding occurred when one or more residues from positions 21-27 in the Ralstonia repeat were substituted into the *Xanthomonas* repeat.

Hybrid repeat units are combined in series to create novel TALE proteins able to recognize any desired proteins. These novel TALE DNA binding domains are also linked to nuclease domains, transcriptional regulatory domain, or any other active protein domain to cause a measurable result following DNA interaction.

Example 21

Construction of TALE-Zinc Finger DNA Binding Domain Hybrids

Zinc fingers were fused to TALE DNA binding domains to create a hybrid DNA binding domain which was then linked to a nuclease. The target DNA sequences are shown below, and comprise a region surrounding a locus within the CCR5 gene. Shown above and below the binding site are the target binding sites for the TALE DNA binding domain and the zinc finger binding site is shown on the target sequence in Bold underline. The "TAG" sequence in Bold/underline is the binding site for the fourth finger from the CCR5-specific ZFN SBS#8267, while the "AAACTG" sequence in Bold/underline is the binding site for the third and fourth fingers in the CCR5-specific ZFN SBS#8196 (see U.S. patent application 11/805,707). The sequences below show that the zinc finger DNA targets are not contiguous with the TALE DNA binding domain targets on the DNA strand, creating the "inner gap". Thus, this type of fusion allows the practitioner to skip a region of DNA if desired within the inner gap region.(Full-length sequences disclosed as SEQ ID NOS 545 and 546, respectively, in order of appearance.)

```
5'TTTGTGGGCAACAT   (101025, SEQ ID NO: 455)
5'TTTGTGGGCAACATGCT (10126, SEQ ID NO: 456)
5'GTTTTGTGGGCAACATGCTGGTCATCCTCATCCTGATAAACTGCAAAAGGCTGAAGAGCATGACTGACATCTAC
   CAAAACACCCGTTGTACGACCAGTAGGAGTAGGACTATTTGACGTTTTCCGACTTCTCGTACTGACTGTAGATG 5'
                              (101035, SEQ ID NO: 457)         TTCCGACTTCTCGT 5'
                               (101036, SEQ ID NO: 458)         TCCGACTTCTCGTACT 5'
                                     (101037, SEQ ID NO: 459)  TCTCGTACTGACTGT 5'
                                     (101038, SEQ ID NO: 460)    TCGTACTGACTGTAGAT
```

The table below, Table 40, shows the results of the studies. In these studies, one nuclease partner is field constant with an inner gap of either 7, 10, or 13 bases. The partner nuclease is then paired with proteins that comprise an inner gap of between 4 and 16 bases. As is shown in the table, TALE/zinc finger hybrid DNA binding domains can form active nuclease pairs when the inner gaps range from 4 to 16 bases.

TABLE 40

Zinc Finger- TALE DNA binding domain hybrids

| sample # | 8267finger TALE-ZFN_L | Inner gap (bp) TALE-ZFP gap | 8196finger TALE-ZFN_R | Inner gap (bp) TALE-ZFP gap | Inter gap (bp) | NHEJ % |
|---|---|---|---|---|---|---|
| 1 | GFP | | | | | <1.0 |
| 2 | 1-101025F4 | 13 | 6-101038F4 | 16 | 5 | 3.7 |
| 3 | 1-101025F4 | 13 | 7-101037F4 | 14 | 5 | 6.8 |
| 4 | 1-101025F4 | 13 | 8-101036F4 | 7 | 5 | 11.7 |
| 5 | 1-101025F4 | 13 | 9-101035F4 | 6 | 5 | 16.1 |
| 6 | 1-101025F4 | 13 | 10-101038F34 | 13 | 5 | 26.4 |
| 7 | 1-101025F4 | 13 | 11-101037F34 | 11 | 5 | 13.4 |
| 8 | 1-101025F4 | 13 | 12-101036F34 | 4 | 5 | 1.9 |
| 9 | 101028 | | 101036 | | | 24.5 |
| 10 | 2-101025F34 | 10 | 6-101038F4 | 16 | 5 | 23.6 |
| 11 | 2-101025F34 | 10 | 7-101037F4 | 14 | 5 | 14.4 |
| 12 | 2-101025F34 | 10 | 8-101036F4 | 7 | 5 | 12.4 |
| 13 | 2-101025F34 | 10 | 9-101035F4 | 6 | 5 | 18.1 |
| 14 | 2-101025F34 | 10 | 10-101038F34 | 13 | 5 | 32.2 |
| 15 | 2-101025F34 | 10 | 11-101037F34 | 11 | 5 | 31.4 |
| 16 | 2-101025F34 | 10 | 12-101036F34 | 4 | 5 | 8.1 |
| 17 | 8267 | | 8196 | | | 49.6 |
| 18 | 3-101026F4 | 10 | 6-101038F4 | 16 | 5 | <1.0 |
| 19 | 3-101026F4 | 10 | 7-101037F4 | 14 | 5 | <1.0 |
| 20 | 3-101026F4 | 10 | 8-101036F4 | 7 | 5 | <1.0 |
| 21 | 3-101026F4 | 10 | 9-101035F4 | 6 | 5 | <1.0 |
| 22 | 3-101026F4 | 10 | 10-101038F34 | 13 | 5 | 6.4 |
| 23 | 3-101026F4 | 10 | 11-101037F34 | 11 | 5 | 10.7 |
| 24 | 3-101026F4 | 10 | 12-101036F34 | 4 | 5 | <1.0 |
| 25 | 8267 | | 101036 | | | 1.8 |
| 26 | 4-101026F34 | 7 | 6-101038F4 | 16 | 5 | 34.1 |
| 27 | 4-101026F34 | 7 | 7-101037F4 | 14 | 5 | 17.3 |
| 28 | 4-101026F34 | 7 | 8-101036F4 | 7 | 5 | 12.6 |
| 29 | 4-101026F34 | 7 | 9-101035F4 | 6 | 5 | 53.3 |
| 30 | 4-101026F34 | 7 | 10-101038F34 | 13 | 5 | 42.6 |
| 31 | 4-101026F34 | 7 | 11-101037F34 | 11 | 5 | 44.7 |
| 32 | 4-101026F34 | 7 | 12-101036F34 | 4 | 5 | 36.3 |

Example 22

Construction of a TALE-Integrase Fusion Protein

During the life cycle of retroviruses, viral genomic RNAs are reverse transcribed and integrated at many different sites into host genome, even though there are preferences for certain hot spots. For applications utilizing retroviral vectors, especially gene therapy, the possible carcinogenicity of retroviral vectors due to random integration of engineered viral genome near oncogene loci presents a potential risk factor. To overcome such potential problems, the specificity of viral integrases is re-directed to pre-determined sites by utilizing specific TALE DNA-binding domains. Fusions are made with whole or truncated integrases and with whole or truncated integrase-binding proteins (for example LEDGF for HIV integrase).

Additionally, fusion pairs are made where one member of the pair is an integrate fused to one protein (for example protein1) and the second pair is a fusion of a TALE DNA binding domain with another protein (for example protein2) where protein1 and protein2 bind to each other. The fusion pairs are cloned into an expression vector such that the pair is expressed in the cell of interest. For a mammalian genomic target, the fusion pair is expressed using a mammalian expression vector. During expression of the TALEN fusions, a donor DNA is supplied such that the donor is incorporated into the cleavage site following TALEN-induced DNA fusion.

Example 23

Sequences of Various TALE Constructs

DNA and Protein Sequences
Complete TALEN Construct Sequence, with Coding Sequence Underlined (SEQ ID NO:217):

```
GACTCTTCGCGATGTACGGGCCAGATATACGCGTTGACATTGATTATTGACTAGTTATTAATAGTAATCAATTACGGGGTCATTAGTTCATAGCCCA

TATATGGAGTTCCGCGTTACATAACTTACGGTAAATGGCCCGCCTGGCTGACCGCCCAACGACCCCCGCCCATTGACGTCAATAATGACGTATGTTC

CCATAGTAACGCCAATAGGGACTTTCCATTGACGTCAATGGGTGGAGTATTTACGGTAAACTGCCCACTTGGCAGTACATCAAGTGTATCATATGCC

AAGTACGCCCCCTATTGACGTCAATGACGGTAAATGGCCCGCCTGGCATTATGCCCAGTACATGACCTTATGGGACTTTCCTACTTGGCAGTACATC

TACGTATTAGTCATCGCTATTACCATGGTGATGCGGTTTTGGCAGTACATCAATGGGCGTGGATAGCGGTTTGACTCACGGGGATTTCCAAGTCTCC

ACCCCATTGACGTCAATGGGAGTTTGTTTTGGCACCAAAATCAACGGGACTTTCCAAAATGTCGTAACAACTCCGCCCCATTGACGCAAATGGGCGG

TAGGCGTGTACGGTGGGAGGTCTATATAAGCAGAGCTCTCTGGCTAACTAGAGAACCCACTGCTTACTGGCTTATCGAAATTAATACGACTCACTAT

AGGGAGACCCAAGCTGGCTAGCGTTTAAACTTAAGCTGATCCACTAGTCCAGTGTGGTGGAATTCGCCATGGACTACAAAGACCATGACGGTGATTA

TAAAGATCATGACATCGATTACAAGGATGACGATGACAAGATGGCCCCCAAGAAGAAGAGGAAGGTGGGCATTCACGGGGTACCCGCCGCTGTGGAT

CTACGCACGCTCGGCTACAGCCAGCAGCAACAGGAGAAGATCAAACCGAAGGTTCGTTCGACAGTGGCGCAGCACCACGAGGCACTGGTCGGCCATG

GGTTTACACACGCGCACATCGTTGCGCTCAGCCAACACCCGGCAGCGTTAGGGACCGTCGCTGTCAAGTATCAGGACATGATCGCAGCGTTGCCAGA
```

GGCGACACACGAAGCGATCGTTGGCGTCGGCAAACAGTGGTCCGGCGCACGCGCCCTGGAGGCCTTGCTCACGGTGGCGGGAGAGTTGAGAGGTCCA
CCGTTACAGTTGGACACAGGCCAACTTCTCAAGATTGCAAAACGTGGCGGCGTGACCGCAGTGGAGGCAGTGCATGCATGGCGCAATGCACTGACGG
GGGCCCCCCTGAACCTTACTCCCGAACAAGTAGTAGCGATAGCCAGTAATAACGGAGGTAAACAAGCCTTGGAGACGGTCCAAAGGTTGCTCCCGGT
CTTGTGTCAGGCACATGGGCTGACGCCTCAACAGGTCGTCGCGATAGCGTCTAATAATGGAGGAAAGCAAGCTCTGGAAACCGTCCAGCGACTCCTT
CCGGTTCTGTGCCAGGCTCATGGTCTGACTCCGCAGCAAGTCGTTGCTATAGCGTCCAACATCGGAGGCAAACAGGCCCTGGAGACCGTGCAGCGGT
TGTTGCCTGTGCTTTGCCAAGCCCACGGGCTTACGCCTGAGCAAGTGGTGGCGATTGCCAGTAACAACGGCGGCAAACAAGCCCTTGAGACTGTGCA
GAGGCTCTTGCCGGTACTCTGCCAAGCACACGGCTTGACCCCCGAGCAGGTTGTAGCCATAGCTAGTCACGACGGGGTAAGCAAGCGTTGGAAACG
GTGCAAGCACTTCTCCCCGTTCTCTGTCAAGCGCATGGACTTACCCCGGAACAGGTGGTCGCCATTGCAAGCCATGATGGAGGAAAGCAGGCGCTCG
AAACAGTCCAGGCACTTTTGCCCGTACTTTGTCAAGCTCACGGTCTCACCCCGGAACAGGTGGTAGCCATTGCATCTAACATCGGAGGTAAGCAAGC
ATTGGAAACGGTTCAGGCCCTGTTGCCTGTACTTTGCCAGGCGCACGGTCTGACACCTGAGCAGGTTGTCGCCATCGCTAGCAACGGAGGTGGGAAA
CAGGCACTTGAAACTGTGCAGAGGCTTCTGCCGGTGCTGTGCCAAGCGCATGGCCTTACACCCGAGCAAGTAGTGGCTATTGCGAGTCATGATGGAG
GCAAGCAAGCGCTGGAGACTGTCCAACGACTTCTTCCGGTCTTGTGTCAGGCACATGGATTGACCCCTCAACAAGTCGTGGCGATAGCTAGCAACGG
CGGTGGAAAACAGGCCCTCGAAACCGTCCAGCGACTGCTCCCCGTACTGTGTCAAGCCCATGGACTTACCCCAGAACAAGTTGTGGCGATTGCCTCT
AACAATGGTGGGAAGCAAGCTCTTGAGACGGTGCAGGCGTTGTTGCCCGTGCTTTGTCAAGCTCACGGGCTCACGCCAGAGCAAGTGGTCGCTATCG
CGAGTAATAAAGGGGGCAAACAAGCCTTGGAGACAGTGCAAAGGCTCCTGCCAGTGCTCTGCCAGGCTCATGGTTTGACACCCGAACAGGTAGTTGC
AATAGCGAGTCATGATGGCGGAAAGCAAGCTCTTGAAACTGTGCAGCGGCTGTTGCCTGTACTGTGTCAAGCCCACGGGCTGACACCGGAACAAGTT
GTAGCGATCGCTAGCCACGATGGCGGGAAACAAGCTCTGGAAACGGTACAGAGACTCCTCCCAGTGCTTTGTCAGGCACACGGCCTCACGCCAGAGC
AGGTTGTCGCCATCGCGTCAAACAATGGTGGAAAGCAGGCCCTGGAGACAGTCCAACGGTTGCTGCCGGTCCTTTGCCAGGCTCACGGGTTGACCCC
CCAGCAGGTCGTGGCCATTGCCTCAAACAAGGGCGGTAGGCCAGCATTGGAGACGGTGCAGAGGCTTCTGCCTGTGCTCTGCCAAGCGCATGGACTC
ACCCCCGAGCAAGTGGTTGCTATCGCAAGTAACAACGGAGGGAAACAAGCGCTCGAAACCGTGCAAAGGTTGCTCCCCGTTCTCTGTCAGGCGCACG
GTCTTACGCCACAACAGGTGGTGGCGATTGCATCTAATGGAGGCGGACGCCCTGCCTTGGAGAGCATTGTGGCCCAGCTGTCCAGGCCGACCCTGC
CCTGGCCGCGTTAACCAACGACCACCTCGTCGCCTTGGCCTGCCTCGGCGGAGGTTCTGGCGGCAGCGGATCCCAGCTGGTGAAGAGCGAGCTGGAG
GAGAAGAAGTCCGAGCTGCGGCACAAGCTGAAGTACGTGCCCCACGAGTACATCGAGCTGATCGAGATCGCCAGGAACAGCACCCAGGACCGCATCC
TGGAGATGAAGGTGATGGAGTTCTTCATGAAGGTGTACGGCTACAGGGGAAAGCACCTGGGCGGAAGCAGAAAGCCTGACGGCGCCATCTATACAGT
GGGCAGCCCCATCGATTACGGCGTGATCGTGGACACAAAGGCCTACAGCGGCGGCTACAATCTGCCTATCGGCCAGGCCGACGAGATGCAGAGATAC
GTGGAGGAGAACCAGACCCGGAATAAGCACATCAACCCCAACGAGTGGTGGAAGGTGTACCCTAGCAGCGTGACCGAGTTCAAGTTCCTGTTCGTGA
GCGGCCACTTCAAGGGCAACTACAAGGCCCAGCTGACCAGGCTGAACCACATCACCAACTGCAATGGCGCCGTGCTGAGCGTGGAGGAGCTGCTGAT
CGGCGGCGAGATGATCAAAGCCGGCACCCTGACACTGGAGGAGGTGCGGCGCAAGTTCAACAACGGCGAGATCAACTTCAGATCTTGATAACTCGAG
TCTAGAGGGCCCGTTTAAACCCGCTGATCAGCCTCGACTGTGCCTTCTAGTTGCCAGCCATCTGTTGTTTGCCCCTCCCCCGTGCCTTCCTTGACCC
TGGAAGGTGCCACTCCCACTGTCCTTTCCTAATAAAATGAGGAAATTGCATCGCATTGTCTGAGTAGGTGTCATTCTATTCTGGGGGGTGGGGTGGG
GCAGGACAGCAAGGGGGAGGATTGGGAAGACAATAGCAGGCATGCTGGGGATGCGGTGGGCTCTATGGCTTCTACTGGGCGGTTTTATGGACAGCAA
GCGAACCGGAATTGCCAGCTGGGGCGCCCTCTGGTAAGGTTGGGAAGCCCTGCAAAGTAAACTGGATGGCTTTCTCGCCGCCAAGGATCTGATGGCG
CAGGGGATCAAGCTCTGATCAAGAGACAGGATGAGGATCGTTTCGCATGATTGAACAAGATGGATTGCACGCAGGTTCTCCGGCCGCTTGGGTGGAG
AGGCTATTCGGCTATGACTGGGCACAACAGACAATCGGCTGCTCTGATGCCGCCGTGTTCCGGCTGTCAGCGCAGGGGCGCCCGGTTCTTTTTGTCA
AGACCGACCTGTCCGGTGCCCTGAATGAACTGCAAGACGAGGCAGCGCGGCTATCGTGGCTGGCCACGACGGGCGTTCCTTGCGCAGCTGTGCTCGA
CGTTGTCACTGAAGCGGGAAGGGACTGGCTGCTATTGGGCGAAGTGCCGGGGCAGGATCTCCTGTCATCTCACCTTGCTCCTGCCGAGAAAGTATCC
ATCATGGCTGATGCAATGCGGCGGCTGCATACGCTTGATCCGGCTACCTGCCCATTCGACCACCAAGCGAAACATCGCATCGAGCGAGCACTACTC
GGATGGAAGCCGGTCTTGTCGATCAGGATGATCTGGACGAAGAGCATCAGGGGCTCGCGCCAGCCGAACTGTTCGCCAGGCTCAAGGCGAGCATGCC
CGACGGCGAGGATCTCGTCGTGACCCATGGCGATGCCTGCTTGCCGAATATCATGGTGGAAAATGGCCGCTTTTCTGGATTCATCGACTGTGGCCGG
CTGGGTGTGGCGGACCGCTATCAGGACATAGCGTTGGCTACCCGTGATATTGCTGAAGAGCTTGGCGGCGAATGGGCTGACCGCTTCCTCGTGCTTT

```
ACGGTATCGCCGCTCCCGATTCGCAGCGCATCGCCTTCTATCGCCTTCTTGACGAGTTCTTCTGAATTATTAACGCTTACAATTTCCTGATGCGGTA

TTTTCTCCTTACGCATCTGTGCGGTATTTCACACCGCATACAGGTGGCACTTTTCGGGGAAATGTGCGCGGAACCCCTATTTGTTTATTTTTCTAAA

TACATTCAAATATGTATCCGCTCATGAGACAATAACCCTGATAAATGCTTCAATAATAGCACGTGCTAAAACTTCATTTTTAATTTAAAAGGATCTA

GGTGAAGATCCTTTTTGATAATCTCATGACCAAAATCCCTTAACGTGAGTTTTCGTTCCACTGAGCGTCAGACCCCGTAGAAAAGATCAAAGGATCT

TCTTGAGATCCTTTTTTTCTGCGCGTAATCTGCTGCTTGCAAACAAAAAAACCACCGCTACCAGCGGTGGTTTGTTTGCCGGATCAAGAGCTACCAA

CTCTTTTTCCGAAGGTAACTGGCTTCAGCAGAGCGCAGATACCAAATACTGTCCTTCTAGTGTAGCCGTAGTTAGGCCACCACTTCAAGAACTCTGT

AGCACCGCCTACATACCTCGCTCTGCTAATCCTGTTACCAGTGGCTGCTGCCAGTGGCGATAAGTCGTGTCTTACCGGGTTGGACTCAAGACGATAG

TTACCGGATAAGGCGCAGCGGTCGGGCTGAACGGGGGGTTCGTGCACACAGCCCAGCTTGGAGCGAACGACCTACACCGAACTGAGATACCTACAGC

GTGAGCTATGAGAAAGCGCCACGCTTCCCGAAGGGAGAAAGGCGGACAGGTATCCGGTAAGCGGCAGGGTCGGAACAGGAGAGCGCACGAGGGAGCT

TCCAGGGGGAAACGCCTGGTATCTTTATAGTCCTGTCGGGTTTCGCCACCTCTGACTTGAGCGTCGATTTTTGTGATGCTCGTCAGGGGGCGGAGCCTATG

GAAAAACGCCAGCAACGCGGCCTTTTTACGGTTCCTGGGCTTTTGCTGGCCTTTTGCTCACATGTTCTT
```

Complete Protein and Coding Sequence for Each TALEN
Used in NTF3 Modification and In Vitro Cleavage Studies To regenerate the sequence of each expression construct, replace the underlined region of the above construct with each CDS shown below.

>NT_L +28

(SEQ ID NO: 218)

MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPEQVVAIASNNGGKQA
LETVQRLLPVLCQAHGLTPQQVVAIASNNGGKQALETVQRLLPVLCQAHGLTPQQVVAIASNIGGKQALETVQRLLPVLCQAHGLTPEQVVAIASNN
GGKQALETVQRLLPVLCQAHGLTPEQVVAIASHDGGKQALETVQALLPVLCQAHGLTPEQVVAIASHDGGKQALETVQALLPVLCQAHGLTPEQVVA
IASNIGGKQALETVQALLPVLCQAHGLTPEQVVAIASNGGGKQALETVQRLLPVLCQAHGLTPEQVVAIASHDGGKQALETVQRLLPVLCQAHGLTP
QQVVAIASNGGGKQALETVQRLLPVLCQAHGLTPEQVVAIASNNGGKQALETVQALLPVLCQAHGLTPEQVVAIASNKGGKQALETVQRLLPVLCQA
HGLTPEQVVAIASHDGGKQALETVQRLLPVLCQAHGLTPEQVVAIASHDGGKQALETVQRLLPVLCQAHGLTPEQVVAIASNNGGKQALETVQRLLP
VLCQAHGLTPQQVVAIASNKGGRPALETVQRLLPVLCQAHGLTPEQVVAIASNNGGKQALETVQRLLPVLCQAHGLTPQQVVAIASNGGGRPALESI
VAQLSRPDPALAALTNDHLVALACLGGGSGGSGSQLVKSELEEKKSELRHKLKYVPHEYIELIEIARNSTQDRILEMKVMEFFMKVYGYRGKHLGGS
RKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNG
AVLSVEELLIGGEMIKAGTLTLEEVRRKFNNGEINFRS

>NT_L +28

(SEQ ID NO: 219)

ATGGACTACAAAGACCATGACGGTGATTATAAAGATCATGACATCGATTACAAGGATGACGATGACAAGATGGCCCCCAAGAAGAAGAGGAAGGTGG
GCATTCACGGGGTACCCGCCGCTGTGGATCTACGCACGCTCGGCTACAGCCAGCAGCAACAGGAGAAGATCAAACCGAAGGTTCGTTCGACAGTGGC
GCAGCACCACGAGGCACTGGTCGGCCATGGGTTTACACACGCGCACATCGTTGCGCTCAGCCAACACCCGGCAGCGTTAGGGACCGTCGCTGTCAAG
TATCAGGACATGATCGCAGCGTTGCCAGAGGCGACACACGAAGCGATCGTTGGCGTCGGCAAACAGTGGTCCGGCGCACGCGCCCTGGAGGCCTTGC
TCACGGTGGCGGGAGAGTTGAGAGGTCCACCGTTACAGTTGGACACAGGCCAACTTCTCAAGATTGCAAAACGTGGCGGCGTGACCGCAGTGGAGGC
AGTGCATGCATGGCGCAATGCACTGACGGGGCCCCCCTGAACCTTACTCCCGAACAAGTAGTAGCGATAGCCAGTAATAACGGAGGTAAACAAGCC
TTGGAGACGGTCCAAAGGTTGCTCCCGGTCTTGTGTCAGGCACATGGGCTGACGCCTCAACAGGTCGTCGCGATAGCGTCTAATAATGGAGGAAAGC
AAGCTCTGGAAACCGTCCAGCGACTCCTTCCGGTTCTGTGCCAGGCTCATGGTCTGACTCCGCAGCAAGTCGTTGCTATAGCGTCCAACATCGGAGG
CAAACAGGCCCTGGAGACCGTGCAGCGGTTGTTGCCTGTGCTTTGCCAAGCCCACGGGCTTACGCCTGAGCAAGTGGTGGCGATTGCCAGTAACAAC
GGCGGCAAACAAGCCCTTGAGACTGTGCAGAGGCTCTTGCCGGTACTCTGCCAAGCACACGGCTTGACCCCCGAGCAGGTTGTAGCCATAGCTAGTC
ACGACGGGGTAAGCAAGCGTTGGAAACGGTGCAAGCACTTCTCCCCGTTCTCTGTCAAGCGCATGGACTTACCCCGGAACAGGTGGTCGCCATTGC
AAGCCATGATGGAGGAAAGCAGGCGCTCGAAACAGTCCAGGCACTTTTGCCCGTACTTTGTCAAGCTCACGGTCTCACCCCGGAACAGGTGGTAGCC

-continued

ATTGCATCTAACATCGGAGGTAAGCAAGCATTGGAAACGGTTCAGGCCCTGTTGCCTGTACTTTGCCAGGCGCACGGTCTGACACCTGAGCAGGTTG
TCGCCATCGCTAGCAACGGAGGTGGGAAACAGGCACTTGAAACTGTGCAGAGGCTTCTGCCGGTGCTGTGCCAAGCGCATGGCCTTACACCCGAGCA
AGTAGTGGCTATTGCGAGTCATGATGGAGGCAAGCAAGCGCTGGAGACTGTCCAACGACTTCTTCCGGTCTTGTGTCAGGCACATGGATTGACCCCT
CAACAAGTCGTGGCGATAGCTAGCAACGGCGGTGGAAAACAGGCCCTCGAAACCGTCCAGCGACTGCTCCCCGTACTGTGTCAAGCCCATGGACTTA
CCCCAGAACAAGTTGTGGCGATTGCCTCTAACAATGGTGGGAAGCAAGCTCTTGAGACGGTGCAGGCGTTGTTGCCCGTGCTTTGTCAAGCTCACGG
GCTCACGCCAGAGCAAGTGGTCGCTATCGCGAGTAATAAAGGGGGCAAACAAGCCTTGGAGACAGTGCAAAGGCTCCTGCCAGTGCTCTGCCAGGCT
CATGGTTTGACACCCGAACAGGTAGTTGCAATAGCGAGTCATGATGGCGGAAAGCAAGCTCTTGAAACTGTGCAGCGGCTGTTGCCTGTACTGTGTC
AAGCCCACGGGCTGACACCGGAACAAGTTGTAGCGATCGCTAGCCACGATGGCGGGAAACAAGCTCTGGAAACGGTACAGAGACTCCTCCCAGTGCT
TTGTCAGGCACACGGCCTCACGCCAGAGCAGGTTGTCGCCATCGCGTCAAACAATGGTGGAAAGCAGGCCCTGGAGACAGTCCAACGGTTGCTGCCG
GTCCTTTGCCAGGCTCACGGGTTGACCCCCCAGCAGGTCGTGGCCATTGCCTCAAACAAGGGCGGTAGGCCAGCATTGGAGACGGTGCAGAGGCTTC
TGCCTGTGCTCTGCCAAGCGCATGGACTCACCCCCGAGCAAGTGGTTGCTATCGCAAGTAACAACGGAGGGAAACAAGCGCTCGAAACCGTGCAAAG
GTTGCTCCCCGTTCTCTGTCAGGCGCACGGTCTTACGCCACAACAGGTGGTGGCGATTGCATCTAATGGAGGCGGACGCCCTGCCTTGGAGAGCATT
GTGGCCCAGCTGTCCAGGCCGGACCCTGCCCTGGCCGCGTTAACCAACGACCACCTCGTCGCCTTGGCCTGCCTCGGCGGAGGTTCTGGCGGCAGCG
GATCCCAGCTGGTGAAGAGCGAGCTGGAGGAGAAGAAGTCCGAGCTGCGGCACAAGCTGAAGTACGTGCCCCACGAGTACATCGAGCTGATCGAGAT
CGCCAGGAACAGCACCCAGGACCGCATCCTGGAGATGAAGGTGATGGAGTTCTTCATGAAGGTGTACGGCTACAGGGGAAAGCACCTGGGCGGAAGC
AGAAAGCCTGACGGCGCCATCTATACAGTGGGCAGCCCCATCGATTACGGCGTGATCGTGGACACAAAGGCCTACAGCGGCGGCTACAATCTGCCTA
TCGGCCAGGCCGACGAGATGCAGAGATACGTGGAGGAGAACCAGACCCGGAATAAGCACATCAACCCCAACGAGTGGTGGAAGGTGTACCCTAGCAG
CGTGACCGAGTTCAAGTTCCTGTTCGTGAGCGGCCACTTCAAGGGCAACTACAAGGCCCAGCTGACCAGGCTGAACCACATCACCAACTGCAATGGC
GCCGTGCTGAGCGTGGAGGAGCTGCTGATCGGCGGCGAGATGATCAAAGCCGGCACCCTGACACTGGAGGAGGTGCGGCGCAAGTTCAACAACGGCG
AGATCAACTTCAGATCT

>NT_L +63                                                                                              (SEQ ID NO: 220)

MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRNALTGAPLNLTPEQVVAIASNNGGKQAL
ETVQRLLPVLCQAHGLTPQQVVAIASNNGGKQALETVQRLLPVLCQAHGLTPQQVVAIASNIGGKQALETVQRLLPVLCQAHGLTPEQVVAIASNNG
GKQALETVQRLLPVLCQAHGLTPEQVVAIASHDGGKQALETVQALLPVLCQAHGLTPEQVVAIASHDGGKQALETVQALLPVLCQAHGLTPEQVVAI
ASNIGGKQALETVQALLPVLCQAHGLTPEQVVAIASNGGGKQALETVQRLLPVLCQAHGLTPEQVVAIASHDGGKQALETVQRLLPVLCQAHGLTPQ
QVVAIASNGGGKQALETVQRLLPVLCQAHGLTPEQVVAIASNNGGKQALETVQALLPVLCQAHGLTPEQVVAIASNKGGKQALETVQRLLPVLCQAH
GLTPEQVVAIASHDGGKQALETVQRLLPVLCQAHGLTPEQVVAIASHDGGKQALETVQRLLPVLCQAHGLTPEQVVAIASNNGGKQALETVQRLLPV
LCQAHGLTPQQVVAIASNKGGRPALETVQRLLPVLCQAHGLTPEQVVAIASNNGGKQALETVQRLLPVLCQAHGLTPQQVVAIASNGGGRPALESIV
AQLSRPDPALAALTNDHLVALACLGGRPALDAVKKGLPHAPALIKRTNRRIPERTSHRVAGSQLVKSELEEKKSELRHKLKYVPHEYIELIEIARNS
TQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEF
KFLFVSGHFKGNYKAQLTRLNHITNCNGAVLSVEELLIGGEMIKAGTLTLEEVRRKFNNGEINFRS

>NT_L +63                                                                                              (SEQ ID NO: 221)

ATGGACTACAAAGACCATGACGGTGATTATAAAGATCATGACATCGATTACAAGGATGACGATGACAAGATGGCCCCCAAGAAGAAGAGGAAGGTGG
GCATTCACGGGGTACCCATGGTGGATCTACGCACGCTCGGCTACAGCCAGCAGCAACAGGAGAAGATCAAACCGAAGGTTCGTTCGACAGTGGCGCA
GCACCACGAGGCACTGGTCGGCCATGGGTTTACACACGCGCACATCGTTGCGCTCAGCCAACACCCGGCAGCGTTAGGGACCGTCGCTGTCAAGTAT
CAGGACATGATCGCAGCGTTGCCAGAGGCGACACACGAAGCGATCGTTGGCGTCGGCAAACAGTGGTCCGGCGCACGCGCCCTGGAGGCCTTGCTCA
CGGTGGCGGGAGAGTTGAGAGGTCCACCGTTACAGTTGGACACAGGCCAACTTCTCAAGATTGCAAAACGTGGCGGCGTGACCGCAGTGGAGGCAGT
GCATGCATGGCGCAATGCACTGACGGGGGCCCCCCTGAACCTTACTCCCGAACAAGTAGTAGCGATAGCCAGTAATAACGGAGGTAAACAAGCCTTG
GAGACGGTCCAAAGGTTGCTCCCGGTCTTGTGTCAGGCACATGGCTGACGCCTCAACAGGTCGTCGCGATAGCGTCTAATAATGGAGGAAAGCAAG
CTCTGGAAACCGTCCAGCGACTCCTTCCGGTTCTGTGCCAGGCTCATGGTCTGACTCCGCAGCAAGTCGTTGCTATAGCGTCCAACATCGGAGGCAA

```
ACAGGCCCTGGAGACCGTGCAGCGGTTGTTGCCTGTGCTTTGCCAAGCCCACGGGCTTACGCCTGAGCAAGTGGTGGCGATTGCCAGTAACAACGGC
GGCAAACAAGCCCTTGAGACTGTGCAGAGGCTCTTGCCGGTACTCTGCCAAGCACACGGCTTGACCCCCGAGCAGGTTGTAGCCATAGCTAGTCACG
ACGGGGGTAAGCAAGCGTTGGAAACGGTGCAAGCACTTCTCCCCGTTCTCTGTCAAGCGCATGGACTTACCCCGGAACAGGTGGTCGCCATTGCAAG
CCATGATGGAGGAAAGCAGGCGCTCGAAACAGTCCAGGCACTTTTGCCCGTACTTTGTCAAGCTCACGGTCTCACCCCGGAACAGGTGGTAGCCATT
GCATCTAACATCGGAGGTAAGCAAGCATTGGAAACGGTTCAGGCCCTGTTGCCTGTACTTTGCCAGGCGCACGGTCTGACACCTGAGCAGGTTGTCG
CCATCGCTAGCAACGGAGGTGGGAAACAGGCACTTGAAACTGTGCAGAGGCTTCTGCCGGTGCTGTGCCAAGCGCATGGCCTTACACCCGAGCAAGT
AGTGGCTATTGCGAGTCATGATGGAGGCAAGCAAGCGCTGGAGACTGTCCAACGACTTCTTCCGGTCTTGTGTCAGGCACATGGATTGACCCCTCAA
CAAGTCGTGGCGATAGCTAGCAACGGCGGTGGAAAACAGGCCCTCGAAACCGTCCAGCGACTGCTCCCCGTACTGTGTCAAGCCCATGGACTTACCC
CAGAACAAGTTGTGGCGATTGCCTCTAACAATGGTGGGAAGCAAGCTCTTGAGACGGTGCAGGCGTTGTTGCCCGTGCTTTGTCAAGCTCACGGGCT
CACGCCAGAGCAAGTGGTCGCTATCGCGAGTAATAAAGGGGGCAAACAAGCCTTGGAGACAGTGCAAAGGCTCCTGCCAGTGCTCTGCCAGGCTCAT
GGTTTGACACCCGAACAGGTAGTTGCAATAGCGAGTCATGATGGCGGAAAGCAAGCTCTTGAAACTGTGCAGCGGCTGTTGCCTGTACTGTGTCAAG
CCCACGGGCTGACACCGGAACAAGTTGTAGCGATCGCTAGCCACGATGGCGGGAAACAAGCTCTGGAAACGGTACAGAGACTCCTCCCAGTGCTTTG
TCAGGCACACGGCCTCACGCCAGAGCAGGTTGTCGCCATCGCGTCAAACAATGGTGGAAAGCAGGCCCTGGAGACAGTCCAACGGTTGCTGCCGGTC
CTTTGCCAGGCTCACGGGTTGACCCCCCAGCAGGTCGTGGCCATTGCCTCAAACAAGGGCGGTAGGCCAGCATTGGAGACGGTGCAGAGGCTTCTGC
CTGTGCTCTGCCAAGCGCATGGACTCACCCCCGAGCAAGTGGTTGCTATCGCAAGTAACAACGGAGGGAAACAAGCGCTCGAAACCGTGCAAAGGTT
GCTCCCCGTTCTCTGTCAGGCGCACGGTCTTACGCCACAACAGGTGGTGGCGATTGCATCTAATGGAGGCGGACGCCCTGCCTTGGAGAGCATTGTG
GCCCAGCTGTCCAGGCCGGACCCTGCCCTGGCCGCGTTAACCAACGACCACCTCGTCGCCTTGGCCTGCCTCGGCGGACGTCCTGCGCTGGATGCAG
TGAAAAAGGGATTGCCGCACGCGCCGGCCTTGATCAAAAGAACCAATCGCCGTATTCCCGAACGCACATCCCATCGCGTTGCCGGATCCCAGCTGGT
GAAGAGCGAGCTGGAGGAGAAGAAGTCCGAGCTGCGGCACAAGCTGAAGTACGTGCCCCACGAGTACATCGAGCTGATCGAGATCGCCAGGAACAGC
ACCCAGGACCGCATCCTGGAGATGAAGGTGATGGAGTTCTTCATGAAGGTGTACGGCTACAGGGGAAAGCACCTGGGCGGAAGCAGAAAGCCTGACG
GCGCCATCTATACAGTGGGCAGCCCCATCGATTACGGCGTGATCGTGGACACAAAGGCCTACAGCGGCGGCTACAATCTGCCTATCGGCCAGGCCGA
CGAGATGCAGAGATACGTGGAGGAGAACCAGACCCGGAATAAGCACATCAACCCCAACGAGTGGTGGAAGGTGTACCCTAGCAGCGTGACCGAGTTC
AAGTTCCTGTTCGTGAGCGGCCACTTCAAGGGCAACTACAAGGCCCAGCTGACCAGGCTGAACCACATCACCAACTGCAATGGCGCCGTGCTGAGCG
TGGAGGAGCTGCTGATCGGCGGCGAGATGATCAAAGCCGGCACCCTGACACTGGAGGAGGTGCGGCGCAAGTTCAACAACGGCGAGATCAACTTCAG
ATCT

>NT_R +28
                                                                                               (SEQ ID NO: 222)
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKAGGVTAVEAVHAWRNALTGAPLNLTPEQVVAIASNNGGKQAL
ETVQRLLPVLCQAHGLTPAQVVAIASNIGGKQALETVQRLLPVLCQAHGLTPDQVVAIASNIGGKQALETVQRLLPVLCQAHGLTPAQVVAIASHDG
GKQALETVQRLLPVLCQAHGLTPEQVVAIASNIGGKQALETVQRLLPVLCQAHGLTPDQVVAIASNKGGKQALETVQRLLPVLCQAHGLTPDQVVAI
ASNIGGKQALETVQRLLPVLCQAHGLTPEQVVAIASNIGGKQALETVQRLLPVLCQAHGLTPDQVVAIASNGGGKQALETVQRLLPVLCQAHGLTPE
QVVAIASHDGGKQALETVQRLLPVLCQAHGLTPQVVAIASNGGGKQALETVQRLLPVLCQAHGLTPEQVVAIASNKGGKQALETVQRLLPVLCQAH
GLTPDQVVAIASHDGGKQALETVQRLLPVLCQAHGLTPAQVVAIASNNGGKQALETVQRLLPVLCQAHGLTPEQVVAIASHDGGKQALETVQRLLPV
LCQAHGLTPQVVAIASNKGGKQALETVQRLLPVLCQAHGLTPEQVVAIASNNGGKQALETVQRLLPVLCQAHGLTPEQVVAIASNGGGRPALESIV
AQLSRPDPALAALTNDHLVALACLGGSQLVKSELEEKKSELRHKLKYVPHEYIELIEIARNSTQDRILEMKVMEFFMKVYGYRGKHLGGSRKPDGAI
YTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEE
LLIGGEMIKAGTLTLEEVRRKFNNGEINFRS
```

-continued

>NT_R +28

(SEQ ID NO: 223)

ATGGACTACAAAGACCATGACGGTGATTATAAAGATCATGACATCGATTACAAGGATGACGATGACAAGATGGCCCCCAAGAAGAAGAGGAAGGTGG
GCATTCACGGGGTACCTATGGTGGACTTGAGGACACTCGGTTATTCGCAACAGCAACAGGAGAAAATCAAGCCTAAGGTCAGGAGCACCGTCGCGCA
ACACCACGAGGCGCTTGTGGGGCATGGCTTCACTCATGCGCATATTGTCGCGCTTTCACAGCACCCTGCGGCGCTTGGGACGGTGGCTGTCAAATAC
CAAGATATGATTGCGGCCCTGCCCGAAGCCACGCACGAGGCAATTGTAGGGGTCGGTAAACAGTGGTCGGGAGCGCGAGCACTTGAGGCGCTGCTGA
CTGTGGCGGGTGAGCTTAGGGGGCCTCCGCTCCAGCTCGACACCGGGCAGCTGCTGAAGATCGCGAAGAGAGGGGGAGTAACAGCGGTAGAGGCAGT
GCACGCCTGGCGCAATGCGCTCACCGGGGCCCCCTTGAATCTTACTCCAGAGCAGGTCGTCGCAATCGCGTCGAATAACGGGGGAAAGCAAGCACTG
GAAACCGTGCAGAGGTTGTTGCCGGTCTTGTGTCAGGCTCACGGCTTGACACCTGCCCAAGTGGTGGCCATTGCGTCGAACATCGGGGGAAAACAGG
CACTTGAAACAGTCCAGAGACTTTTGCCCGTCCTCTGCCAGGCGCACGGCCTCACGCCGGATCAGGTGGTAGCCATCGCGTCAAACATCGGAGGGAA
GCAGGCTCTGGAAACGGTGCAGCGGCTTTTGCCGGTACTTTGCCAAGCTCATGGGCTCACGCCAGCCCAAGTGGTAGCTATCGCATCGCACGACGGA
GGGAAGCAGGCCTTGGAGACAGTGCAACGGCTCCTCCCCGTGTTGTGCCAGGCACATGGGTTGACTCCAGAGCAGGTCGTAGCAATCGCCTCCAATA
TCGGGGGAAAGCAAGCGTTGGAGACAGTGCAGCGACTGCTGCCTGTGCTTTGCCAGGCTCATGGCCTGACGCCCGATCAGGTAGTGGCAATCGCGTC
AAACAAAGGTGGAAAGCAGGCACTCGAAACGGTACAGCGCTTGCTGCCCGTCTTGTGTCAGGCCCACGGTCTGACACCCGACCAGGTAGTCGCGATT
GCGTCGAACATCGGGGGAAAGCAAGCGTTGGAAACGGTACAACGCCTGCTCCCGGTGCTCTGCCAGGCTCATGGACTTACACCCGAGCAGGTGGTCG
CCATCGCGTCAAACATCGGAGGCAAACAGGCATTGGAGACAGTGCAGCGCCTTCTCCCAGTCTTGTGTCAGGCCCACGGTCTGACACCCGACCAGGT
CGTCGCGATTGCATCGAATGGAGGTGGGAAACAGGCCCTTGAGACAGTACAGAGGCTTTTGCCCGTGTTGTGCCAGGCCCACGGACTCACACCCGAA
CAAGTCGTCGCCATTGCCAGCCATGATGGAGGTAAACAGGCACTTGAGACTGTCCAGCGCCTCCTGCCGGTGCTGTGCCAAGCACATGGGCTGACCC
CGCAGCAAGTCGTAGCGATCGCCTCGAATGGTGGAGGAAAACAAGCGCTTGAAACCGTCCAGAGGTTGCTCCCGGTGCTGTGCCAGGCACATGGCCT
TACGCCTGAACAAGTAGTCGCGATTGCCAGCAACAAAGGCGGAAAACAGGCTCTCGAAACGGTCCAGCGGTTGCTGCCGGTGTTGTGCCAGGCGCAC
GGTCTTACACCGGACCAGGTGGTGGCGATTGCCTCCCACGATGGGGGTAAACAGGCACTGGAAACCGTGCAGAGATTGCTCCCAGTACTTTGTCAGG
CACATGGTCTGACTCCTGCTCAAGTGGTCGCGATCGCCTCGAACAATGGCGGAAAGCAGGCGCTCGAAACGGTACAGCGGCTCCTTCCGGTGCTCTG
CCAAGCCCACGGATTGACGCCAGAACAGGTCGTGGCAATTGCGTCACACGACGGTGGAAAGCAGGCGCTCGAAACTGTGCAAAGACTCCTGCCCGTA
CTCTGCCAGGCACACGGTTTGACTCCCCAGCAGGTAGTGGCCATCGCGAGCAATAAGGGAGGAAAGCAGGCGCTTGAAACGGTGCAGAGACTTCTGC
CCGTGCTTTGTCAAGCCCACGGGCTGACTCCGGAGCAGGTAGTGGCCATCGCCTCAAACAACGGAGGAAAGCAAGCTCTCGAAACCGTACAGAGGCT
TCTCCCCGTGCTCTGTCAGGCCCACGGGTTGACCCCCGAACAGGTGGTCGCCATTGCTAGCAACGGGGAGGACGGCCAGCCTTGGAGTCCATCGTA
GCCCAATTGTCCAGGCCCGATCCCGCGTTGGCTGCGTTAACGAATGACCATCTGGTGGCGTTGGCATGTCTTGGTGGATCCCAGCTGGTGAAGAGCG
AGCTGGAGGAGAAGAAGTCCGAGCTGCGGCACAAGCTGAAGTACGTGCCCCACGAGTACATCGAGCTGATCGAGATCGCCAGGAACAGCACCCAGGA
CCGCATCCTGGAGATGAAGGTGATGGAGTTCTTCATGAAGGTGTACGGCTACAGGGGAAAGCACCTGGGCGGAAGCAGAAAGCCTGACGGCGCCATC
TATACAGTGGGCAGCCCCATCGATTACGGCGTGATCGTGGACACAAAGGCCTACAGCGGCGGCTACAATCTGCCTATCGGCCAGGCCGACGAGATGC
AGAGATACGTGGAGGAGAACCAGACCCGGAATAAGCACATCAACCCCAACGAGTGGTGGAAGGTGTACCCTAGCAGCGTGACCGAGTTCAAGTTCCT
GTTCGTGAGCGGCCACTTCAAGGGCAACTACAAGGCCCAGCTGACCAGGCTGAACCACATCACCAACTGCAATGGCGCCGTGCTGAGCGTGGAGGAG
CTGCTGATCGGCGGCGAGATGATCAAAGCCGGCACCCTGACACTGGAGGAGGTGCGGCGCAAGTTCAACAACGGCGAGATCAACTTCAGATCT

>NT_R +63, (also referred to as rNT3 C+63)

(SEQ ID NO: 224)

MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRNALTGAPLNLTPEQVVAIASNNGGKQAL
ETVQRLLPVLCQAHGLTPAQVVAIASNIGGKQALETVQRLLPVLCQAHGLTPDQVVAIASNIGGKQALETVQRLLPVLCQAHGLTPAQVVAIASHDG
GKQALETVQRLLPVLCQAHGLTPEQVVAIASNIGGKQALETVQRLLPVLCQAHGLTPDQVVAIASNKGGKQALETVQRLLPVLCQAHGLTPDQVVAI
ASNIGGKQALETVQRLLPVLCQAHGLTPEQVVAIASNIGGKQALETVQRLLPVLCQAHGLTPDQVVAIASNGGGKQALETVQRLLPVLCQAHGLTPE
QVVAIASHDGGKQALETVQRLLPVLCQAHGLTPQQVVAIASNGGGKQALETVQRLLPVLCQAHGLTPEQVVAIASNKGGKQALETVQRLLPVLCQAH
GLTPDQVVAIASHDGGKQALETVQRLLPVLCQAHGLTPAQVVAIASNNGGKQALETVQRLLPVLCQAHGLTPEQVVAIASHDGGKQALETVQRLLPV
LCQAHGLTPQQVVAIASNKGGKQALETVQRLLPVLCQAHGLTPEQVVAIASNNGGKQALETVQRLLPVLCQAHGLTPEQVVAIASNGGGRPALESIV

-continued

AQLSRPDPALAALTNDHLVALACLGGRPALDAVKKGLPHAPALIKRTNRRIPERTSHRVAGSQLVKSELEEKKSELRHKLKYVPHEYIELIEIARNS
TQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEF
KFLFVSGHFKGNYKAQLTRLNHITNCNGAVLSVEELLIGGEMIKAGTLTLEEVRRKFNNGEINFRS

>NT_R +63

(SEQ ID NO: 225)

ATGGACTACAAAGACCATGACGGTGATTATAAAGATCATGACATCGATTACAAGGATGACGATGACAAGATGGCCCCCAAGAAGAAGAGGAAGGTGG
GCATTCACGGGGTACCTATGGTGGACTTGAGGACACTCGGTTATTCGCAACAGCAACAGGAGAAAATCAAGCCTAAGGTCAGGAGCACCGTCGCGCA
ACACCACGAGGCGCTTGTGGGGCATGGCTTCACTCATGCGCATATTGTCGCGCTTTCACAGCACCCTGCGGCGCTTGGGACGGTGGCTGTCAAATAC
CAAGATATGATTGCGGCCCTGCCCGAAGCCACGCACGAGGCAATTGTAGGGGTCGGTAAACAGTGGTCGGGAGCGCGAGCACTTGAGGCGCTGCTGA
CTGTGGCGGGTGAGCTTAGGGGGCCTCCGCTCCAGCTCGACACCGGGCAGCTGCTGAAGATCGCGAAGAGAGGGGGAGTAACAGCGGTAGAGGCAGT
GCACGCCTGGCGCAATGCGCTCACCGGGGCCCCCTTGAATCTTACTCCAGAGCAGGTCGTCGCAATCGCGTCGAATAACGGGGGAAAGCAAGCACTG
GAAACCGTGCAGAGGTTGTTGCCGGTCTTGTGTCAGGCTCACGGCTTGACACCTGCCCAAGTGGTGGCCATTGCGTCGAACATCGGGGGAAAACAGG
CACTTGAAACAGTCCAGAGACTTTTGCCCGTCCTCTGCCAGGCGCACGGCCTCACGCCGGATCAGGTGGTAGCCATCGCGTCAAACATCGGAGGGAA
GCAGGCTCTGGAAACGGTGCAGCGGCTTTTGCCGGTACTTTGCCAAGCTCATGGGCTCACGCCAGCCCAAGTGGTAGCTATCGCATCGCACGACGGA
GGGAAGCAGGCCTTGGAGACAGTGCAACGGCTCCTCCCCGTGTTGTGCCAGGCACATGGGTTGACTCCAGAGCAGGTCGTAGCAATCGCCTCCAATA
TCGGGGGAAAGCAAGCGTTGGAGACAGTGCAGCGACTGCTGCCTGTGCTTTGCCAGGCTCATGGCCTGACGCCCGATCAGGTAGTGGCAATCGCGTC
AAACAAAGGTGGAAAGCAGGCACTCGAAACGGTACAGCGCTTGCTGCCCGTCTTGTGTCAGGCCCACGGTCTGACACCCGACCAGGTAGTCGCGATT
GCGTCGAACATCGGGGGAAAGCAAGCGTTGGAAACGGTACAACGCCTGCTCCCGGTGCTCTGCCAGGCTCATGGACTTACACCCGAGCAGGTGGTCG
CCATCGCGTCAAACATCGGAGGCAAACAGGCATTGGAGACAGTGCAGCGCCTTCTCCCAGTCTTGTGTCAGGCCCACGGTCTGACACCCGACCAGGT
CGTCGCGATTGCATCGAATGGAGGTGGGAAACAGGCCCTTGAGACAGTACAGAGGCTTTTGCCCGTGTTGTGCCAGGCCCACGGACTCACACCCGAA
CAAGTCGTCGCCATTGCCAGCCATGATGGAGGTAAACAGGCACTTGAGACTGTCCAGCGCCTCCTGCCGGTGCTGTGCCAAGCACATGGGCTGACCC
CGCAGCAAGTCGTAGCGATCGCCTCGAATGGTGGAGGAAAACAAGCGCTTGAAACCGTCCAGAGGTTGCTCCCGGTGCTGTGCCAGGCACATGGCCT
TACGCCTGAACAAGTAGTCGCGATTGCCAGCAACAAAGGCGGAAAACAGGCTCTCGAAACGGTCCAGCGGTTGCTGCCGGTGTTGTGCCAGGCGCAC
GGTCTTACACCGGACCAGGTGGTGGCGATTGCCTCCCACGATGGGGGTAAACAGGCACTGGAAACCGTGCAGAGATTGCTCCCAGTACTTTGTCAGG
CACATGGTCTGACTCCTGCTCAAGTGGTCGCGATCGCCTCGAACAATGGCGGAAAGCAGGCGCTCGAAACGGTACAGCGGCTCCTTCCGGTGCTCTG
CCAAGCCCACGGATTGACGCCAGAACAGGTCGTGGCAATTGCGTCACACGACGGTGGAAAGCAGGCGCTCGAAACTGTGCAAAGACTCCTGCCCGTA
CTCTGCCAGGCACACGGTTTGACTCCCCAGCAGGTAGTGGCCATCGCGAGCAATAAGGGAGGAAAGCAGGCGCTTGAAACGGTGCAGAGACTTCTGC
CCGTGCTTTGTCAAGCCCACGGGCTGACTCCGGAGCAGGTAGTGGCCATCGCCTCAAACAACGGAGGAAAGCAAGCTCTCGAAACCGTACAGAGGCT
TCTCCCCGTGCTCTGTCAGGCCCACGGGTTGACCCCCGAACAGGTGGTCGCCATTGCTAGCAACGGGGAGGACGGCCAGCCTTGGAGTCCATCGTA
GCCCAATTGTCCAGGCCCGATCCCGCGTTGGCTGCGTTAACGAATGACCATCTGGTGGCGTTGGCATGTCTTGGTGGACGACCCGCGCTCGATGCAG
TCAAAAAGGGTCTGCCTCATGCTCCCGCATTGATCAAAAGAACCAACCGGCGGATTCCCGAGAGAACTTCCCATCGAGTCGCGGGATCCCAGCTGGT
GAAGAGCGAGCTGGAGGAGAAGAAGTCCGAGCTGCGGCACAAGCTGAAGTACGTGCCCCACGAGTACATCGAGCTGATCGAGATCGCCAGGAACAGC
ACCCAGGACCGCATCCTGGAGATGAAGGTGATGGAGTTCTTCATGAAGGTGTACGGCTACAGGGGAAAGCACCTGGGCGGAAGCAGAAAGCCTGACG
GCGCCATCTATACAGTGGGCAGCCCCATCGATTACGGCGTGATCGTGGACACAAAGGCCTACAGCGGCGGCTACAATCTGCCTATCGGCCAGGCCGA
CGAGATGCAGAGATACGTGGAGGAGAACCAGACCCGGAATAAGCACATCAACCCCAACGAGTGGTGGAAGGTGTACCCTAGCAGCGTGACCGAGTTC
AAGTTCCTGTTCGTGAGCGGCCACTTCAAGGGCAACTACAAGGCCCAGCTGACCAGGCTGAACCACATCACCAACTGCAATGGCGCCGTGCTGAGCG
TGGAGGAGCTGCTGATCGGCGGCGAGATGATCAAAGCCGGCACCCTGACACTGGAGGAGGTGCGGCGCAAGTTCAACAACGGCGAGATCAACTTCAG
ATCT

>TALE13 +28 (also referred to as rNT#C+28)

(SEQ ID NO: 226)

MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRNALTGAPLNLTPEQVVAIASNIGGKQAL

-continued

ETVQRLLPVLCQAHGLTPEQVVAIASNGGKQALETVQRLLPVLCQAHGLTPEQVVAIASNIGGKQALETVQRLLPVLCQAHGLTPEQVVAIASNIGG

KQALETVQRLLPVLCQAHGLTPAQVVAIASNIGGKQALETVQRLLPVLRQAHGLTPEQVVAIASNGGKQALETVQRLLPVLCQAHGLTPAQVVAIAS

NIGGKQALETVQRLLPVLCQAHGLTPEQVVAIASHDGGKQALETVQRLLPVLCQAHGLTPEQVVAIASHDGGKQALETVQRLLPVLCQAHGLTPDQV

VAIASNGGGKQALETVQRLLPVLCQAHGLTPDQVVAIASNGGGKQALETVQRLLPVLCQAHGLTPEQVVAIASHDGGKQALETVQRLLPVLCQAHGL

TPEQVVAIASNGGGRPALESIVAQLSRPDPSLAALTNDHLVALACLGGSQLVKSELEEKKSELRHKLKYVPHEYIELIEIARNSTQDRILEMKVMEF

FMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNY

KAQLTRLNHITNCNGAVLSVEELLIGGEMIKAGTLTLEEVRRKFNNGEINFRS

>TALE13_+28 (SEQ ID NO: 227)

ATGGACTACAAAGACCATGACGGTGATTATAAAGATCATGACATCGATTACAAGGATGACGATGACAAGATGGCCCCCAAGAAGAAGAGGAAGGTGG

GCATTCACGGGGTACCCATGGTGGATCTACGCACGCTCGGCTACAGCCAGCAGCAACAGGAGAAGATCAAACCGAAGGTTCGTTCGACAGTGGCGCA

GCACCACGAGGCACTGGTCGGCCATGGGTTTACACACGCGCACATCGTTGCGCTCAGCCAACACCCGGCAGCGTTAGGGACCGTCGCTGTCAAGTAT

CAGGACATGATCGCAGCGTTGCCAGAGGCGACACACGAAGCGATCGTTGGCGTCGGCAAACAGTGGTCCGGCGCACGCGCCCTGGAGGCCTTGCTCA

CGGTGGCGGAGAGTTGAGAGGTCCACCGTTACAGTTGGACACAGGCCAACTTCTCAAGATTGCAAAACGTGGCGGCGTGACCGCAGTGGAGGCAGT

GCATGCATGGCGCAATGCACTGACGGGGGCCCCCCTGAACCTGACCCCGGAGCAGGTGGTGGCCATCGCCAGCAATATTGGTGGCAAGCAGGCGCTG

GAGACGGTGCAGCGGCTGTTGCCGGTGCTGTGCCAGGCCCATGGCCTGACCCCGGAGCAGGTGGTGGCCATCGCCAGCAATGGCGGCAAGCAGGCGC

TGGAGACGGTGCAGCGGCTGTTGCCGGTGCTGTGCCAGGCCCATGGCCTGACCCCGGAGCAGGTGGTGGCCATCGCCAGCAATATTGGTGGCAAGCA

GGCGCTGGAGACGGTGCAGCGGCTGTTGCCGGTGCTGTGCCAGGCCCATGGCCTGACCCCGGAGCAGGTGGTGGCCATCGCCAGCAATATTGGTGGC

AAGCAGGCGCTGGAGACGGTGCAGCGGCTGTTGCCGGTGCTGTGCCAGGCCCATGGCCTGACCCCGGCACAGGTGGTGGCCATCGCCAGCAATATTG

GCGGCAAGCAGGCGCTGGAGACGGTGCAGCGGCTGTTGCCGGTGCTGCGCCAGGCCCATGGCCTGACCCCGGAGCAGGTCGTGGCCATCGCCAGCAA

TGGCGGCAAGCAGGCGCTGGAGACGGTGCAGCGGCTGTTGCCGGTGCTGTGCCAGGCCCATGGCCTGACCCCGGAGCAGGTCGTGGCCATCG

CCAGCCACGATGGCGGCAAGCAGGCGCTGGAGACGGTGCAGCGGCTGTTGCCGGTGCTGTGCCAGGCCCATGGCCTGACCCCGGAGCAGGTGGTGGC

CATCGCCAGCCACGATGGCGGCAAGCAGGCGCTGGAGACGGTGCAGCGGCTGTTGCCGGTGCTGTGCCAGGCCCATGGCCTGACCCCGGACCAGGTG

GTGGCCATCGCCAGCAATGGCGGTGGCAAGCAGGCGCTGGAGACGGTGCAGCGGCTGTTGCCGGTGCTGTGCCAGGCCCATGGCCTGACCCCGGACC

AGGTGGTGGCCATCGCCAGCAATGGCGGTGGCAAGCAGGCGCTGGAGACGGTGCAGCGGCTGTTGCCGGTGCTGTGCCAGGCCCATGGCCTGACCCC

GGAGCAGGTGGTGGCCATCGCCAGCCACGATGGCGGCAAGCAGGCGCTGGAGACGGTGCAGCGGCTGTTGCCGGTGCTGTGCCAGGCCCATGGCCTG

ACCCCGGAGCAGGTGGTGGCCATCGCCAGCAATGGCGGCGGCAGGCCGGCGCTGGAGAGCATTGTTGCCCAGTTATCTCGCCCTGATCCGTCGTTGG

CCGCGTTAACCAACGACCACCTCGTCGCCTTGGCCTGCCTCGGCGGATCCCAGCTGGTGAAGAGCGAGCTGGAGGAGAAGAAGTCCGAGCTGCGGCA

CAAGCTGAAGTACGTGCCCCACGAGTACATCGAGCTGATCGAGATCGCCAGGAACAGCACCCAGGACCGCATCCTGGAGATGAAGGTGATGGAGTTC

TTCATGAAGGTGTACGGCTACAGGGGAAAGCACCTGGGCGGAAGCAGAAAGCCTGACGGCGCCATCTATACAGTGGGCAGCCCCATCGATTACGGCG

TGATCGTGGACACAAAGGCCTACAGCGGCGGCTACAATCTGCCTATCGGCCAGGCCGACGAGATGCAGAGATACGTGGAGGAGAACCAGACCCGGAA

TAAGCACATCAACCCCAACGAGTGGTGGAAGGTGTACCCTAGCAGCGTGACCGAGTTCAAGTTCCTGTTCGTGAGCGGCCACTTCAAGGGCAACTAC

AAGGCCCAGCTGACCAGGCTGAACCACATCACCAACTGCAATGGCGCCGTGCTGAGCGTGGAGGAGCTGCTGATCGGCGGCGAGATGATCAAAGCCG

GCACCCTGACACTGGAGGAGGTGCGGCGCAAGTTCAACAACGGCGAGATCAACTTCAGATCT

>TALE13 +39, (also referred to as rNT3, C+39) (SEQ ID NO: 228)

MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKY

QDMIAALPEATHEAIVGVGKQWSGARALEALLTVAGELRGPPLQLDTGQLLKIARAGGVTAVEAVHAWRNALTGAPLNLTPEQVVAIASNIGGKQAL

ETVQRLLPVLCQAHGLTPEQVVAIASNGGKQALETVQRLLPVLCQAHGLTPEQVVAIASNIGGKQALETVQRLLPVLCQAHGLTPEQVVAIASNIGG

KQALETVQRLLPVLCQAHGLTPAQVVAIASNIGGKQALETVQRLLPVLRQAHGLTPEQVVAIASNGGKQALETVQRLLPVLCQAHGLTPAQVVAIAS

NIGGKQALETVQRLLPVLCQAHGLTPEQVVAIASHDGGKQALETVQRLLPVLCQAHGLTPEQVVAIASHDGGKQALETVQRLLPVLCQAHGLTPDQV

VAIASNGGGKQALETVQRLLPVLCQAHGLTPDQVVAIASNGGGKQALETVQRLLPVLCQAHGLTPEQVVAIASHDGGKQALETVQRLLPVLCQAHGL

TPEQVVAIASNGGGRPALESIVAQLSRPDPSLAALTNDHLVALACLGGRPALDAVKKGGSQLVKSELEEKKSELRHKLKYVPHEYIELIEIARNSTQ
DRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKF
LFVSGHFKGNYKAQLTRLNHITNCNGAVLSVEELLIGGEMIKAGTLTLEEVRRKFNNGEINFRS

>TALE13 +39 (SEQ ID NO: 229)
ATGGACTACAAAGACCATGACGGTGATTATAAAGATCATGACATCGATTACAAGGATGACGATGACAAGATGGCCCCCAAGAAGAAGAGGAAGGTGG
GCATTCACGGGGTACCCATGGTGGATCTACGCACGCTCGGCTACAGCCAGCAGCAACAGGAGAAGATCAAACCGAAGGTTCGTTCGACAGTGGCGCA
GCACCACGAGGCACTGGTCGGCCATGGGTTTACACACGCGCACATCGTTGCGCTCAGCCAACACCCGGCAGCGTTAGGGACCGTCGCTGTCAAGTAT
CAGGACATGATCGCAGCGTTGCCAGAGGCGACACACGAAGCGATCGTTGGCGTCGGCAAACAGTGGTCCGGCGCACGCGCCCTGGAGGCCTTGCTCA
CGGTGGCGGGAGAGTTGAGAGGTCCACCGTTACAGTTGGACACAGGCCAACTTCTCAAGATTGCAAAACGTGGCGGCGTGACCGCAGTGGAGGCAGT
GCATGCATGGCGCAATGCACTGACGGGGGCCCCCCTGAACCTGACCCCGGAGCAGGTGGTGGCCATCGCCAGCAATATTGGTGGCAAGCAGGCGCTG
GAGACGGTGCAGCGGCTGTTGCCGGTGCTGTGCCAGGCCCATGGCCTGACCCCGGAGCAGGTGGTGGCCATCGCCAGCAATGGCGGCAAGCAGGCGC
TGGAGACGGTGCAGCGGCTGTTGCCGGTGCTGTGCCAGGCCCATGGCCTGACCCCGGAGCAGGTGGTGGCCATCGCCAGCAATATTGGTGGCAAGCA
GGCGCTGGAGACGGTGCAGCGGCTGTTGCCGGTGCTGTGCCAGGCCCATGGCCTGACCCCGGCACAGGTGGTGGCCATCGCCAGCAATATTG
GCGGCAAGCAGGCGCTGGAGACGGTGCAGCGGCTGTTGCCGGTGCTGCGCCAGGCCCATGGCCTGACCCCGGAGCAGGTCGTGGCCATCGCCAGCAA
TGGCGGCAAGCAGGCGCTGGAGACGGTGCAGCGGCTGTTGCCGGTGCTGTGCCAGGCCCATGGCCTGACCCCGGCACAGGTGGTGGCCATCGCCAGC
AATATTGGCGGCAAGCAGGCGCTGGAGACGGTGCAGCGGCTGTTGCCGGTGCTGTGCCAGGCCCATGGCCTGACCCCGGAGCAGGTCGTGGCCATCG
CCAGCCACGATGGCGGCAAGCAGGCGCTGGAGACGGTGCAGCGGCTGTTGCCGGTGCTGTGCCAGGCCCATGGCCTGACCCCGGAGCAGGTGGTGGC
CATCGCCAGCCACGATGGCGGCAAGCAGGCGCTGGAGACGGTGCAGCGGCTGTTGCCGGTGCTGTGCCAGGCCCATGGCCTGACCCCGGACCAGGTG
GTGGCCATCGCCAGCAATGGCGGTGGCAAGCAGGCGCTGGAGACGGTGCAGCGGCTGTTGCCGGTGCTGTGCCAGGCCCATGGCCTGACCCCGGACC
AGGTGGTGGCCATCGCCAGCAATGGCGGTGGCAAGCAGGCGCTGGAGACGGTGCAGCGGCTGTTGCCGGTGCTGTGCCAGGCCCATGGCCTGACCCC
GGAGCAGGTGGTGGCCATCGCCAGCCACGATGGCGGCAAGCAGGCGCTGGAGACGGTGCAGCGGCTGTTGCCGGTGCTGTGCCAGGCCCATGGCCTG
ACCCCGGAGCAGGTGGTGGCCATCGCCAGCAATGGCGGCGGCAGGCCGGCGCTGGAGAGCATTGTTGCCCAGTTATCTCGCCCTGATCCGTCGTTGG
CCGCGTTAACCAACGACCACCTCGTCGCCTTGGCCTGCCTCGGCGGACGTCCTGCGCTGGATGCAGTGAAAAAGGGAGGATCCCAGCTGGTGAAGAG
CGAGCTGGAGGAGAAGAAGTCCGAGCTGCGGCACAAGCTGAAGTACGTGCCCCACGAGTACATCGAGCTGATCGAGATCGCCAGGAACAGCACCCAG
GACCGCATCCTGGAGATGAAGGTGATGGAGTTCTTCATGAAGGTGTACGGCTACAGGGGAAAGCACCTGGGCGGAAGCAGAAAGCCTGACGGCGCCA
TCTATACAGTGGGCAGCCCCATCGATTACGGCGTGATCGTGGACACAAAGGCCTACAGCGGCGGCTACAATCTGCCTATCGGCCAGGCCGACGAGAT
GCAGAGATACGTGGAGGAGAACCAGACCCGGAATAAGCACATCAACCCCAACGAGTGGTGGAAGGTGTACCCTAGCAGCGTGACCGAGTTCAAGTTC
CTGTTCGTGAGCGGCCACTTCAAGGGCAACTACAAGGCCCAGCTGACCAGGCTGAACCACATCACCAACTGCAATGGCGCCGTGCTGAGCGTGGAGG
AGCTGCTGATCGGCGGCGAGATGATCAAAGCCGGCACCCTGACACTGGAGGAGGTGCGGCGCAAGTTCAACAACGGCGAGATCAACTTCAGATCT

>TALE13 +50 (SEQ ID NO: 230)
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRNALTGAPLNLTPEQVVAIASNIGGKQAL
ETVQRLLPVLCQAHGLTPEQVVAIASNGGKQALETVQRLLPVLCQAHGLTPEQVVAIASNIGGKQALETVQRLLPVLCQAHGLTPEQVVAIASNIGG
KQALETVQRLLPVLCQAHGLTPAQVVAIASNIGGKQALETVQRLLPVLRQAHGLTPEQVVAIASNGGKQALETVQRLLPVLCQAHGLTPAQVVAIAS
NIGGKQALETVQRLLPVLCQAHGLTPEQVVAIASHDGGKQALETVQRLLPVLCQAHGLTPEQVVAIASHDGGKQALETVQRLLPVLCQAHGLTPDQV
VAIASNGGGKQALETVQRLLPVLCQAHGLTPDQVVAIASNGGGKQALETVQRLLPVLCQAHGLTPEQVVAIASHDGGKQALETVQRLLPVLCQAHGL
TPEQVVAIASNGGGRPALESIVAQLSRPDPSLAALTNDHLVALACLGGRPALDAVKKGLPHAPALIKRTGSQLVKSELEEKKSELRHKLKYVPHEYI
ELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWK
VYPSSVTEFKFLFVSGHFKGNYKAQLTRLNHITNCNGAVLSVEELLIGGEMIKAGTLTLEEVRRKFNNGEINFRS

>TALE13 +50
(SEQ ID NO: 231)

ATGGACTACAAAGACCATGACGGTGATTATAAAGATCATGACATCGATTACAAGGATGACGATGACAAGATGGCCCCCAAGAAGAAGAGGAAGGTGG
GCATTCACGGGGTACCCATGGTGGATCTACGCACGCTCGGCTACAGCCAGCAGCAACAGGAGAAGATCAAACCGAAGGTTCGTTCGACAGTGGCGCA
GCACCACGAGGCACTGGTCGGCCATGGGTTTACACACGCGCACATCGTTGCGCTCAGCCAACACCCGGCAGCGTTAGGGACCGTCGCTGTCAAGTAT
CAGGACATGATCGCAGCGTTGCCAGAGGCGACACACGAAGCGATCGTTGGCGTCGGCAAACAGTGGTCCGGCGCACGCGCCCTGGAGGCCTTGCTCA
CGGTGGCGGGAGAGTTGAGAGGTCCACCGTTACAGTTGGACACAGGCCAACTTCTCAAGATTGCAAAACGTGGCGGCGTGACCGCAGTGGAGGCAGT
GCATGCATGGCGCAATGCACTGACGGGGGCCCCCCTGAACCTGACCCCGGAGCAGGTGGTGGCCATCGCCAGCAATATTGGTGGCAAGCAGGCGCTG
GAGACGGTGCAGCGGCTGTTGCCGGTGCTGTGCCAGGCCCATGGCCTGACCCCGGAGCAGGTGGTGGCCATCGCCAGCAATGGCGGCAAGCAGGCGC
TGGAGACGGTGCAGCGGCTGTTGCCGGTGCTGTGCCAGGCCCATGGCCTGACCCCGGAGCAGGTGGTGGCCATCGCCAGCAATATTGGTGGCAAGCA
GGCGCTGGAGACGGTGCAGCGGCTGTTGCCGGTGCTGTGCCAGGCCCATGGCCTGACCCCGGAGCAGGTGGTGGCCATCGCCAGCAATATTGGTGGC
AAGCAGGCGCTGGAGACGGTGCAGCGGCTGTTGCCGGTGCTGTGCCAGGCCCATGGCCTGACCCCGGCACAGGTGGTGGCCATCGCCAGCAATATTG
GCGGCAAGCAGGCGCTGGAGACGGTGCAGCGGCTGTTGCCGGTGCTGCGCCAGGCCCATGGCCTGACCCCGGAGCAGGTCGTGGCCATCGCCAGCAA
TGGCGGCAAGCAGGCGCTGGAGACGGTGCAGCGGCTGTTGCCGGTGCTGTGCCAGGCCCATGGCCTGACCCCGGCACAGGTGGTGGCCATCGCCAGC
AATATTGGCGGCAAGCAGGCGCTGGAGACGGTGCAGCGGCTGTTGCCGGTGCTGTGCCAGGCCCATGGCCTGACCCCGGAGCAGGTCGTGGCCATCG
CCAGCCACGATGGCGGCAAGCAGGCGCTGGAGACGGTGCAGCGGCTGTTGCCGGTGCTGTGCCAGGCCCATGGCCTGACCCCGGAGCAGGTGGTGGC
CATCGCCAGCCACGATGGCGGCAAGCAGGCGCTGGAGACGGTGCAGCGGCTGTTGCCGGTGCTGTGCCAGGCCCATGGCCTGACCCCGGACCAGGTG
GTGGCCATCGCCAGCAATGGCGGTGGCAAGCAGGCGCTGGAGACGGTGCAGCGGCTGTTGCCGGTGCTGTGCCAGGCCCATGGCCTGACCCCGGACC
AGGTGGTGGCCATCGCCAGCAATGGCGGTGGCAAGCAGGCGCTGGAGACGGTGCAGCGGCTGTTGCCGGTGCTGTGCCAGGCCCATGGCCTGACCCC
GGAGCAGGTGGTGGCCATCGCCAGCCACGATGGCGGCAAGCAGGCGCTGGAGACGGTGCAGCGGCTGTTGCCGGTGCTGTGCCAGGCCCATGGCCTG
ACCCCGGAGCAGGTGGTGGCCATCGCCAGCAATGGCGGCGGCAGGCCGGCGCTGGAGAGCATTGTTGCCCAGTTATCTCGCCCTGATCCGTCGTTGG
CCGCGTTAACCAACGACCACCTCGTCGCCTTGGCCTGCCTCGGCGGACGTCCTGCGCTGGATGCAGTGAAAAAGGGATTGCCGCACGCGCCGGCCTT
GATCAAAAGAACCGGATCCCAGCTGGTGAAGAGCGAGCTGGAGGAGAAGAAGTCCGAGCTGCGGCACAAGCTGAAGTACGTGCCCCACGAGTACATC
GAGCTGATCGAGATCGCCAGGAACAGCACCCAGGACCGCATCCTGGAGATGAAGGTGATGGAGTTCTTCATGAAGGTGTACGGCTACAGGGGAAAGC
ACCTGGGCGGAAGCAGAAAGCCTGACGGCGCCATCTATACAGTGGGCAGCCCCATCGATTACGGCGTGATCGTGGACACAAAGGCCTACAGCGGCGG
CTACAATCTGCCTATCGGCCAGGCCGACGAGATGCAGAGATACGTGGAGGAGAACCAGACCCGGAATAAGCACATCAACCCCAACGAGTGGTGGAAG
GTGTACCCTAGCAGCGTGACCGAGTTCAAGTTCCTGTTCGTGAGCGGCCACTTCAAGGGCAACTACAAGGCCCAGCTGACCAGGCTGAACCACATCA
CCAACTGCAATGGCGCCGTGCTGAGCGTGGAGGAGCTGCTGATCGGCGGCGAGATGATCAAAGCCGGCACCCTGACACTGGAGGAGGTGCGGCGCAA
GTTCAACAACGGCGAGATCAACTTCAGATCT

>TALE13 +63
(SEQ ID NO: 232)

MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKY
QDMIAALPEATHEATVGVGKQWSGARALEALLTVAGELRGPPLQLDTGQLLKIAKRGGVTAVEAVHAWRNALTGAPLNLTPEQVVAIASNIGGKQAL
ETVQRLLPVLCQAHGLTPEQVVAIASNGGKQALETVQRLLPVLCQAHGLTPEQVVAIASNIGGKQALETVQRLLPVLCQAHGLTPEQVVAIASNIGG
KQALETVQRLLPVLCQAHGLTPAQVVAIASNIGGKQALETVQRLLPVLRQAHGLTPEQVVAIASNGGKQALETVQRLLPVLCQAHGLTPAQVVAIAS
NIGGKQALETVQRLLPVLCQAHGLTPEQVVAIASHDGGKQALETVQRLLPVLCQAHGLTPEQVVAIASHDGGKQALETVQRLLPVLCQAHGLTPDQV
VAIASNGGGKQALETVQRLLPVLCQAHGLTPDQVVAIASNGGGKQALETVQRLLPVLCQAHGLTPEQVVAIASHDGGKQALETVQRLLPVLCQAHGL
TPEQVVAIASNGGGRPALESIVAQLSRPDPSLAALTNDHLVALACLGGRPALDAVKKGLPHAPALIKRTNRRIPERTSHRVAGSQLVKSELEEKKSE
LRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQ
TRNKHINPNEWWKVYPSSVTEFKFLFVSGHFKGNYKAQLTRLNHITNCNGAVLSVEELLIGGEMIKAGTLTLEEVRRKFNNGEINFRS

>TALE13 +63
(SEQ ID NO: 233)

ATGGACTACAAAGACCATGACGGTGATTATAAAGATCATGACATCGATTACAAGGATGACGATGACAAGATGGCCCCCAAGAAGAAGAGGAAGGTGG
GCATTCACGGGGTACCCATGGTGGATCTACGCACGCTCGGCTACAGCCAGCAGCAACAGGAGAAGATCAAACCGAAGGTTCGTTCGACAGTGGCGCA

-continued

```
GCACCACGAGGCACTGGTCGGCCATGGGTTTACACACGCGCACATCGTTGCGCTCAGCCAACACCCGGCAGCGTTAGGGACCGTCGCTGTCAAGTAT
CAGGACATGATCGCAGCGTTGCCAGAGGCGACACACGAAGCGATCGTTGGCGTCGGCAAACAGTGGTCCGGCGCACGCGCCCTGGAGGCCTTGCTCA
CGGTGGCGGGAGAGTTGAGAGGTCCACCGTTACAGTTGGACACAGGCCAACTTCTCAAGATTGCAAAACGTGGCGGCGTGACCGCAGTGGAGGCAGT
GCATGCATGGCGCAATGCACTGACGGGGGCCCCCCTGAACCTGACCCCGGAGCAGGTGGTGGCCATCGCCAGCAATATTGGTGGCAAGCAGGCGCTG
GAGACGGTGCAGCGGCTGTTGCCGGTGCTGTGCCAGGCCCATGGCCTGACCCCGGAGCAGGTGGTGGCCATCGCCAGCAATGGCGGCAAGCAGGCGC
TGGAGACGGTGCAGCGGCTGTTGCCGGTGCTGTGCCAGGCCCATGGCCTGACCCCGGAGCAGGTGGTGGCCATCGCCAGCAATATTGGTGGCAAGCA
GGCGCTGGAGACGGTGCAGCGGCTGTTGCCGGTGCTGTGCCAGGCCCATGGCCTGACCCCGGAGCAGGTGGTGGCCATCGCCAGCAATATTGGTGGC
AAGCAGGCGCTGGAGACGGTGCAGCGGCTGTTGCCGGTGCTGTGCCAGGCCCATGGCCTGACCCCGGCACAGGTGGTGGCCATCGCCAGCAATATTG
GCGGCAAGCAGGCGCTGGAGACGGTGCAGCGGCTGTTGCCGGTGCTGCGCCAGGCCCATGGCCTGACCCCGGAGCAGGTCGTGGCCATCGCCAGCAA
TGGCGGCAAGCAGGCGCTGGAGACGGTGCAGCGGCTGTTGCCGGTGCTGTGCCAGGCCCATGGCCTGACCCCGGCACAGGTGGTGGCCATCGCCAGC
AATATTGGCGGCAAGCAGGCGCTGGAGACGGTGCAGCGGCTGTTGCCGGTGCTGTGCCAGGCCCATGGCCTGACCCCGGAGCAGGTCGTGGCCATCG
CCAGCCACGATGGCGGCAAGCAGGCGCTGGAGACGGTGCAGCGGCTGTTGCCGGTGCTGTGCCAGGCCCATGGCCTGACCCCGGAGCAGGTGGTGGC
CATCGCCAGCCACGATGGCGGCAAGCAGGCGCTGGAGACGGTGCAGCGGCTGTTGCCGGTGCTGTGCCAGGCCCATGGCCTGACCCCGGACCAGGTG
GTGGCCATCGCCAGCAATGGCGGTGGCAAGCAGGCGCTGGAGACGGTGCAGCGGCTGTTGCCGGTGCTGTGCCAGGCCCATGGCCTGACCCCGGACC
AGGTGGTGGCCATCGCCAGCAATGGCGGTGGCAAGCAGGCGCTGGAGACGGTGCAGCGGCTGTTGCCGGTGCTGTGCCAGGCCCATGGCCTGACCCC
GGAGCAGGTGGTGGCCATCGCCAGCCACGATGGCGGCAAGCAGGCGCTGGAGACGGTGCAGCGGCTGTTGCCGGTGCTGTGCCAGGCCCATGGCCTG
ACCCCGGAGCAGGTGGTGGCCATCGCCAGCAATGGCGGCGGCAGGCCGGCGCTGGAGAGCATTGTTGCCCAGTTATCTCGCCCTGATCCGTCGTTGG
CCGCGTTAACCAACGACCACCTCGTCGCCTTGGCCTGCCTCGGCGGACGTCCTGCGCTGGATGCAGTGAAAAAGGGATTGCCGCACGCGCCGGCCTT
GATCAAAAGAACCAATCGCCGTATTCCCGAACGCACATCCCATCGCGTTGCCGGATCCCAGCTGGTGAAGAGCGAGCTGGAGGAGAAGAAGTCCGAG
CTGCGGCACAAGCTGAAGTACGTGCCCCACGAGTACATCGAGCTGATCGAGATCGCCAGGAACAGCACCCAGGACCGCATCCTGGAGATGAAGGTGA
TGGAGTTCTTCATGAAGGTGTACGGCTACAGGGGAAAGCACCTGGGCGGAAGCAGAAAGCCTGACGGCGCCATCTATACAGTGGGCAGCCCCATCGA
TTACGGCGTGATCGTGGACACAAAGGCCTACAGCGGCGGCTACAATCTGCCTATCGGCCAGGCCGACGAGATGCAGAGATACGTGGAGGAGAACCAG
ACCCGGAATAAGCACATCAACCCCAACGAGTGGTGGAAGGTGTACCCTAGCAGCGTGACCGAGTTCAAGTTCCTGTTCGTGAGCGGCCACTTCAAGG
GCAACTACAAGGCCCAGCTGACCAGGCTGAACCACATCACCAACTGCAATGGCGCCGTGCTGAGCGTGGAGGAGCTGCTGATCGGCGGCGAGATGAT
CAAAGCCGGCACCCTGACACTGGAGGAGGTGCGGCGCAAGTTCAACAACGGCGAGATCAACTTCAGATCT
```

>TALE13 +79 (SEQ ID NO: 234)

MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRNALTGAPLAMTPEQVVAIASNIGGKQAL
ETVQRLLPVLCQAHGLTPEQVVAIASNGGKQALETVQRLLPVLCQAHGLTPEQVVAIASNIGGKQALETVQRLLPVLCQAHGLTPEQVVAIASNIGG
KQALETVQRLLPVLCQAHGLTPAQVVAISNIGGKQALETVQRLLPVLRQAHGLTPEQVVAIASNGGKQALETVQRLLPVLCQAHGLTPAQVVAIAS
NIGGKQALETVQRLLPVLCQAHGLTPEQVVAIASHDGGKQALETVQRLLPVLCQAHGLTPEQVVAIASHDGGKQALETVQRLLPVLCQAHGLTPDQV
VAIASNGGGKQALETVQRLLPVLCQAHGLTPDQVVAIASNGGGKQALETVQRLLPVLCQAHGLTPEQVVAIASHDGGKQALETVQRLLPVLCQAHGL
TPEQVVAIASNGGGRPALESIVAQLSRPDPSLAALTNDHLVALACLGGRPALDAVKKGLPHAPALIKRTNRRIPERTSHRVADHAQVVRVLGFFQCH
SGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNL
PIGQADEMQRYVEENQTRNKHINPNEWWKVYPSSVTEFKFLFVSGHFKGNYKAQLTRLNHITNCNGAVLSVEELLIGGEMIKAGTLTLEEVARKFNN
GEINFRS

>TALE13 +79 (SEQ ID NO: 235)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACGGGGTACCCATGGTGGATCTACGCACGCTCGGCTACAGCCAGCAGCAACAGGAGAAGATCAAACCGAAGGTTCGTTCGACAGTGGCGCA
GCACCACGAGGCACTGGTCGGCCATGGGTTTACACACGCGCACATCGTTGCGCTCAGCCAACACCCGGCAGCGTTAGGGACCGTCGCTGTCAAGTAT
```

-continued

```
CAGGACATGATCGCAGCGTTGCCAGAGGCGACACACGAAGCGATCGTTGGCGTCGGCAAACAGTGGTCCGGCGCACGCGCCCTGGAGGCCTTGCTCA
CGGTGGCGGGAGAGTTGAGAGGTCCACCGTTACAGTTGGACACAGGCCAACTTCTCAAGATTGCAAAACGTGGCGGCGTGACCGCAGTGGAGGCAGT
GCATGCATGGCGCAATGCACTGACGGGGGCCCCCCTGAACCTGACCCCGGAGCAGGTGGTGGCCATCGCCAGCAATATTGGTGGCAAGCAGGCGCTG
GAGACGGTGCAGCGGCTGTTGCCGGTGCTGTGCCAGGCCCATGGCCTGACCCCGGAGCAGGTGGTGGCCATCGCCAGCAATGGCGGCAAGCAGGCGC
TGGAGACGGTGCAGCGGCTGTTGCCGGTGCTGTGCCAGGCCCATGGCCTGACCCCGGAGCAGGTGGTGGCCATCGCCAGCAATATTGGTGGCAAGCA
GGCGCTGGAGACGGTGCAGCGGCTGTTGCCGGTGCTGTGCCAGGCCCATGGCCTGACCCCGGAGCAGGTGGTGGCCATCGCCAGCAATATTGGTGGC
AAGCAGGCGCTGGAGACGGTGCAGCGGCTGTTGCCGGTGCTGTGCCAGGCCCATGGCCTGACCCCGGCACAGGTGGTGGCCATCGCCAGCAATATTG
GCGGCAAGCAGGCGCTGGAGACGGTGCAGCGGCTGTTGCCGGTGCTGCGCCAGGCCCATGGCCTGACCCCGGAGCAGGTCGTGGCCATCGCCAGCAA
TGGCGGCAAGCAGGCGCTGGAGACGGTGCAGCGGCTGTTGCCGGTGCTGTGCCAGGCCCATGGCCTGACCCCGGCACAGGTGGTGGCCATCGCCAGC
AATATTGGCGGCAAGCAGGCGCTGGAGACGGTGCAGCGGCTGTTGCCGGTGCTGTGCCAGGCCCATGGCCTGACCCCGGAGCAGGTCGTGGCCATCG
CCAGCCACGATGGCGGCAAGCAGGCGCTGGAGACGGTGCAGCGGCTGTTGCCGGTGCTGTGCCAGGCCCATGGCCTGACCCCGGAGCAGGTGGTGGC
CATCGCCAGCCACGATGGCGGCAAGCAGGCGCTGGAGACGGTGCAGCGGCTGTTGCCGGTGCTGTGCCAGGCCCATGGCCTGACCCCGGACCAGGTG
GTGGCCATCGCCAGCAATGGCGGTGGCAAGCAGGCGCTGGAGACGGTGCAGCGGCTGTTGCCGGTGCTGTGCCAGGCCCATGGCCTGACCCCGGACC
AGGTGGTGGCCATCGCCAGCAATGGCGGTGGCAAGCAGGCGCTGGAGACGGTGCAGCGGCTGTTGCCGGTGCTGTGCCAGGCCCATGGCCTGACCCC
GGAGCAGGTGGTGGCCATCGCCAGCCACGATGGCGGCAAGCAGGCGCTGGAGACGGTGCAGCGGCTGTTGCCGGTGCTGTGCCAGGCCCATGGCCTG
ACCCCGGAGCAGGTGGTGGCCATCGCCAGCAATGGCGGCGGCAGGCCGGCGCTGGAGAGCATTGTTGCCCAGTTATCTCGCCCTGATCCGTCGTTGG
CCGCGTTAACCAACGACCACCTCGTCGCCTTGGCCTGCCTCGGCGGACGTCCTGCGCTGGATGCAGTGAAAAAGGGATTGCCGCACGCGCCGGCCTT
GATCAAAAGAACCAATCGCCGTATTCCCGAACGCACATCCCATCGCGTTGCCGACCACGCGCAAGTGGTTCGCGTGCTGGGTTTTTTCCAGTGCCAC
TCCGATCCCAGCTGGTGAAGAGCGAGCTGGAGGAGAAGAAGTCCGAGCTGCGGCACAAGCTGAAGTACGTGCCCCACGAGTACATCGAGCTGATCG
AGATCGCCAGGAACAGCACCCAGGACCGCATCCTGGAGATGAAGGTGATGGAGTTCTTCATGAAGGTGTACGGCTACAGGGGAAAGCACCTGGGCGG
AAGCAGAAAGCCTGACGGCGCCATCTATACAGTGGGCAGCCCCATCGATTACGGCGTGATCGTGGACACAAAGGCCTACAGCGGCGGCTACAATCTG
CCTATCGGCCAGGCCGACGAGATGCAGAGATACGTGGAGGAGAACCAGACCCGGAATAAGCACATCAACCCCAACGAGTGGTGGAAGGTGTACCCTA
GCAGCGTGACCGAGTTCAAGTTCCTGTTCGTGAGCGGCCACTTCAAGGGCAACTACAAGGCCCAGCTGACCAGGCTGAACCACATCACCAACTGCAA
TGGCGCCGTGCTGAGCGTGGAGGAGCTGCTGATCGGCGGCGAGATGATCAAAGCCGGCACCCTGACACTGGAGGAGGTGCGGCGCAAGTTCAACAAC
GGCGAGATCAACTTCAGATCT
```

>TALE13 +95 (SEQ ID NO: 236)

```
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRNALTGAPLNLTPEQVVAIASNIGGKQAL
ETVQRLLPVLCQAHGLTPEQVVAIASNGGKQALETVQRLLPVLCQAHGLTPEQVVAIASNIGGKQALETVQRLLPVLCQAHGLTPEQVVAIASNIGG
KQALETVQRLLPVLCQAHGLTPAQVVAIASNIGGKQALETVQRLLPVLRQAHGLTPEQVVAIASNGGKQALETVQRLLPVLCQAHGLTPAQVVAIAS
NIGGKQALETVQRLLPVLCQAHGLTPEQVVAISHDGGKQALETVQRLLPVLCQAHGLTPEQVVAIASHDGGKQALETVQRLLPVLCQAHGLTPDQV
VAIASNGGGKQALETVQRLLPVLCQAHGLTPDQVVAIASNGGGKQALETVQRLLPVLCQAHGLTPEQVVAISHDGGKQALETVQRLLPVLCQAHGL
TPEQVVAIASNGGGRPALESIVAQLSRPDPSLAALTNDHLVALACLGGRPALDAVKKGLPHAPALIKRTNRRIPERTSHRVADHAQVVRVLGFFQCH
SHPAQAFDDAMTQFGMSGSQLVKSELEEKKSELRHKLKYVPHEYIELIEIARNSTQDRILEMKVMEFFMKVYGYRGKHLGGSRKPDGAIYTVGSPID
YGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMI
KAGTLTLEEVRRKFNNGEINFRS
```

>TALE13 +95 (SEQ ID NO: 237)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACGGGGTACCCATGGTGGATCTACGCACGCTCGGCTACAGCCAGCAGCAACAGGAGAAGATCAAACCGAAGGTTCGTTCGACAGTGGCGCA
GCACCACGAGGCACTGGTCGGCCATGGGTTTACACACGCGCACATCGTTGCGCTCAGCCAACACCCGGCAGCGTTAGGGACCGTCGCTGTCAAGTAT
CAGGACATGATCGCAGCGTTGCCAGAGGCGACACACGAAGCGATCGTTGGCGTCGGCAAACAGTGGTCCGGCGCACGCGCCCTGGAGGCCTTGCTCA
```

-continued

```
CGGTGGCGGGAGAGTTGAGAGGTCCACCGTTACAGTTGGACACAGGCCAACTTCTCAAGATTGCAAAACGTGGCGGCGTGACCGCAGTGGAGGCAGT

GCATGCATGGCGCAATGCACTGACGGGGGCCCCCCTGAACCTGACCCCGGAGCAGGTGGTGGCCATCGCCAGCAATATTGGTGGCAAGCAGGCGCTG

GAGACGGTGCAGCGGCTGTTGCCGGTGCTGTGCCAGGCCCATGGCCTGACCCCGGAGCAGGTGGTGGCCATCGCCAGCAATGGCGGCAAGCAGGCGC

TGGAGACGGTGCAGCGGCTGTTGCCGGTGCTGTGCCAGGCCCATGGCCTGACCCCGGAGCAGGTGGTGGCCATCGCCAGCAATATTGGTGGCAAGCA

GGCGCTGGAGACGGTGCAGCGGCTGTTGCCGGTGCTGTGCCAGGCCCATGGCCTGACCCCGGAGCAGGTGGTGGCCATCGCCAGCAATATTGGTGGC

AAGCAGGCGCTGGAGACGGTGCAGCGGCTGTTGCCGGTGCTGTGCCAGGCCCATGGCCTGACCCCGGCACAGGTGGTGGCCATCGCCAGCAATATTG

GCGGCAAGCAGGCGCTGGAGACGGTGCAGCGGCTGTTGCCGGTGCTGCGCCAGGCCCATGGCCTGACCCCGGAGCAGGTCGTGGCCATCGCCAGCAA

TGGCGGCAAGCAGGCGCTGGAGACGGTGCAGCGGCTGTTGCCGGTGCTGTGCCAGGCCCATGGCCTGACCCCGGCACAGGTGGTGGCCATCGCCAGC

AATATTGGCGGCAAGCAGGCGCTGGAGACGGTGCAGCGGCTGTTGCCGGTGCTGTGCCAGGCCCATGGCCTGACCCCGGAGCAGGTCGTGGCCATCG

CCAGCCACGATGGCGGCAAGCAGGCGCTGGAGACGGTGCAGCGGCTGTTGCCGGTGCTGTGCCAGGCCCATGGCCTGACCCCGGAGCAGGTGGTGGC

CATCGCCAGCCACGATGGCGGCAAGCAGGCGCTGGAGACGGTGCAGCGGCTGTTGCCGGTGCTGTGCCAGGCCCATGGCCTGACCCCGGACCAGGTG

GTGGCCATCGCCAGCAATGGCGGTGGCAAGCAGGCGCTGGAGACGGTGCAGCGGCTGTTGCCGGTGCTGTGCCAGGCCCATGGCCTGACCCCGGACC

AGGTGGTGGCCATCGCCAGCAATGGCGGTGGCAAGCAGGCGCTGGAGACGGTGCAGCGGCTGTTGCCGGTGCTGTGCCAGGCCCATGGCCTGACCCC

GGAGCAGGTGGTGGCCATCGCCAGCCACGATGGCGGCAAGCAGGCGCTGGAGACGGTGCAGCGGCTGTTGCCGGTGCTGTGCCAGGCCCATGGCCTG

ACCCCGGAGCAGGTGGTGGCCATCGCCAGCAATGGCGGCGGCAGGCCGGCGCTGGAGAGCATTGTTGCCCAGTTATCTCGCCCTGATCCGTCGTTGG

CCGCGTTAACCAACGACCACCTCGTCGCCTTGGCCTGCCTCGGCGGACGTCCTGCGCGTGGATGCAGTGAAAAAGGGATTGCCGCACGCGCCGGCCTT

GATCAAAAGAACCAATCGCCGTATTCCCGAACGCACATCCCATCGCGTTGCCGACCACGCGCAAGTGGTTCGCGTGCTGGGTTTTTTCCAGTGCCAC

TCCCACCCAGCGCAAGCATTTGATGACGCCATGACGCAGTTCGGGATGAGCGGATCCCAGCTGGTGAAGAGCGAGCTGGAGGAGAAGAAGTCCGAGC

TGCGGCACAAGCTGAAGTACGTGCCCCACGAGTACATCGAGCTGATCGAGATCGCCAGGAACAGCACCCAGGACCGCATCCTGGAGATGAAGGTGAT

GGAGTTCTTCATGAAGGTGTACGGCTACAGGGGAAAGCACCTGGGCGGAAGCAGAAAGCCTGACGGCGCCATCTATACAGTGGGCAGCCCCATCGAT

TACGGCGTGATCGTGGACACAAAGGCCTACAGCGGCGGCTACAATCTGCCTATCGGCCAGGCCGACGAGATGCAGAGATACGTGGAGGAGAACCAGA

CCCGGAATAAGCACATCAACCCCAACGAGTGGTGGAAGGTGTACCCTAGCAGCGTGACCGAGTTCAAGTTCCTGTTCGTGAGCGGCCACTTCAAGGG

CAACTACAAGGCCCAGCTGACCAGGCTGAACCACATCACCAACTGCAATGGCGCCGTGCTGAGCGTGGAGGAGCTGCTGATCGGCGGCGAGATGATCAAAGC

CGGCACCCTGACACTGGAGGAGGTGCGGCGCAAGTTCAACAACGGCGAGATCAACTTCAGATCT
```

2. TALEN Constructs and Protein Sequences Used for CCR5 Studies
Complete TALEN Construct Sequence, with Coding Sequence Underlined (SEQ ID NO:238):

```
GACTCTTCGCGATGTACGGGCCAGATATACGCGTTGACATTGATTATTGACTAGTTATTAATAGTAATCAATTACGGGGTCATTAGTTCATAGCCCA

TATATGGAGTTCCGCGTTACATAACTTACGGTAAATGGCCCGCCTGGCTGACCGCCCAACGACCCCCGCCCATTGACGTCAATAATGACGTATGTTC

CCATAGTAACGCCAATAGGGACTTTCCATTGACGTCAATGGGTGGAGTATTTACGGTAAACTGCCCACTTGGCAGTACATCAAGTGTATCATATGCC

AAGTACGCCCCCTATTGACGTCAATGACGGTAAATGGCCCGCCTGGCATTATGCCCAGTACATGACCTTATGGGACTTTCCTACTTGGCAGTACATC

TACGTATTAGTCATCGCTATTACCATGGTGATGCGGTTTTGGCAGTACATCAATGGGCGTGGATAGCGGTTTGACTCACGGGGATTTCCAAGTCTCC

ACCCCATTGACGTCAATGGGAGTTTGTTTTGGCACCAAAATCAACGGGACTTTCCAAAATGTCGTAACAACTCCGCCCCATTGACGCAAATGGGCGG

TAGGCGTGTACGGTGGGAGGTCTATATAAGCAGAGCTCTCTGGCTAACTAGAGAACCCACTGCTTACTGGCTTATCGAAATTAATACGACTCACTAT

AGGGAGAGCCAAGCTGACTAGCGTTTAAACTTAAGCTGATCCACTAGTCCAGTGTGGTGGAATTCGCCATGGACTACAAAGACCATGACGGTGATTA

TAAAGATCATGACATCGATTACAAGGATGACGATGACAAGATGGCCCCCAAGAAGAAGAGGAAGGTGGGCATTCACCGCGGGGTACCTATGGTGGAC

TTGAGGACACTCGGTTATTCGCAACAGCAACAGGAGAAAATCAAGCCTAAGGTCAGGAGCACCGTCGCGCAACACCACGAGGCGCTTGTGGGGCATG

GCTTCACTCATGCGCATATTGTCGCGCTTTCACAGCACCCTGCGGCGCTTGGGACGGTGGCTGTCAAATACCAAGATATGATTGCGGCCCTGCCCGA

AGCCACGCACGAGGCAATTGTAGGGGTCGGTAAACAGTGGTCGGGAGCGCGAGCACTTGAGGCGCTGCTGACTGTGGCGGGTGAGCTTAGGGGGCCT
```

```
CCGCTCCAGCTCGACACCGGGCAGCTGCTGAAGATCGCGAAGAGAGGGGGAGTAACAGCGGTAGAGGCAGTGCACGCCTGGCGCAATGCGCTCACCG

GGGCCCCCTTGAACCTGACCCCAGACCAGGTAGTCGCAATCGCCAACAATAACGGGGGAAAGCAAGCCCTGGAAACCGTGCAAAGGTTGTTGCCGGT

CCTTTGTCAAGACCACGGCCTTACACCGGAGCAAGTCGTGGCCATTGCATCACATGACGGTGGCAAACAGGCTCTTGAGACGGTTCAGAGACTTCTC

CCAGTTCTCTGTCAAGCCCACGGGCTGACTCCCGATCAAGTTGTAGCGATTGCGAGCAATGGGGGAGGGAAACAAGCATTGGAGACTGTCCAACGGC

TCCTTCCCGTGTTGTGTCAAGCCCACGGTTTGACGCCTGCACAAGTGGTCGCCATCGCCAACAACAACGGCGGTAAGCAGGCGCTGGAAACAGTACA

GCGCCTGCTGCCTGTACTGTGCCAGGATCATGGACTCACCCCAGACCAGGTAGTCGCAATCGCCAACAATAACGGGGGAAAGCAAGCCCTGGAAACC

GTGCAAAGGTTGTTGCCGGTCCTTTGTCAAGACCACGGCCTTACACCGGAGCAAGTCGTGGCCATTGCATCAAACGGAGGTGGCAAACAGGCTCTTG

AGACGGTTCAGAGACTTCTCCCAGTTCTCTGTCAAGCCCACGGGCTGACTCCCGATCAAGTTGTAGCGATTGCGAGCCATGATGGAGGGAAACAAGC

ATTGGAGACTGTCCAACGGCTCCTTCCCGTGTTGTGTCAAGCCCACGGTTTGACGCCTGCACAAGTGGTCGCCATCGCCTCCAATATTGGCGGTAAG

CAGGCGCTGGAAACAGTACAGCGCCTGCTGCCTGTACTGTGCCAGGATCATGGGCTGACCCCAGACCAGGTAGTCGCAATCGCGTCGAATGGCGGGG

GAAAGCAAGCCCTGGAAACCGTGCAAAGGTTGTTGCCGGTCCTTTGTCAAGACCACGGCCTTACACCGGAGCAAGTCGTGGCCATTGCATCACATGA

CGGTGGCAAACAGGCTCTTGAGACGGTTCAGAGACTTCTCCCAGTTCTCTGTCAAGCCCACGGGCTGACTCCCGATCAAGTTGTAGCGATTGCGAGC

CATGATGGAGGGAAACAAGCATTGGAGACTGTCCAACGGCTCCTTCCCGTGTTGTGTCAAGCCCACGGTTTGACGCCTGCACAAGTGGTCGCCATCG

CCTCCAACGGTGGCGGTAAGCAGGCGCTGGAAACAGTACAGCGCCTGCTGCCTGTACTGTGCCAGGATCATGGTTTGACCCCAGACCAGGTAGTCGC

AATCGCGTCGCATGACGGGGGAAAGCAAGCCCTGGAAACCGTGCAAAGGTTGTTGCCGGTCCTTTGTCAAGACCACGGCCTTACGCCTGCACAAGTG

GTCGCCATCGCCTCCAATATTGGCGGTAAGCAGGCGCTGGAAACAGTACAGCGCCTGCTGCCTGTACTGTGCCAGGATCATGGCCTGACACCCGAAC

AGGTGGTCGCCATTGCTAGCAACGGGGAGGACGGCCAGCCTTGGAGTCCATCGTAGCCCAATTGTCCAGGCCCGATCCCGCGTTGGCTGCGTTAAC

GAATGACCATCTGGTGGCGTTGGCATGTCTTGGTGGATCCCAGCTGGTGAAGAGCGAGCTGGAGGAGAAGAAGTCCGAGCTGCGGCACAAGCTGAAG

TACGTGCCCCACGAGTACATCGAGCTGATCGAGATCGCCAGGAACAGCACCCAGGACCGCATCCTGGAGATGAAGGTGATGGAGTTCTTCATGAAGG

TGTACGGCTACAGGGGAAAGCACCTGGGCGGAAGCAGAAAGCCTGACGGCGCCATCTATACAGTGGGCAGCCCCATCGATTACGGCGTGATCGTGGA

CACAAAGGCCTACAGCGGCGGCTACAATCTGCCTATCGGCCAGGCCGACGAGATGCAGAGATACGTGGAGGAGAACCAGACCCGGAATAAGCACATC

AACCCCAACGAGTGGTGGAAGGTGTACCCTAGCAGCGTGACCGAGTTCAAGTTCCTGTTCGTGAGCGGCCACTTCAAGGGCAACTACAAGGCCCAGC

TGACCAGGCTGAACCACATCACCAACTGCAATGGCGCCGTGCTGAGCGTGGAGGAGCTGCTGATCGGCGGCGAGATGATCAAAGCCGGCACCCTGAC

ACTGGAGGAGGTGCGGCGCAAGTTCAACAACGGCGAGATCAACTTCAGATCTTGATAACTCGAGTCTAGAGGGCCCGTTTAAACCCGCTGATCAGCC

TCGACTGTGCCTTCTAGTTGCCAGCCATCTGTTGTTTGCCCCTCCCCCGTGCCTTCCTTGACCCTGGAAGGTGCCACTCCCACTGTCCTTTCCTAAT

AAAATGAGGAAATTGCATCGCATTGTCTGAGTAGGTGTCATTCTATTCTGGGGGGTGGGGTGGGGCAGGACAGCAAGGGGGAGGATTGGGAAGACAA

TAGCAGGCATGCTGGGGATGCGGTGGGCTCTATGGCTTCTACTGGGCGGTTTTATGGACAGCAAGCGAACCGGAATTGCCAGCTGGGGCGCCCTCTG

GTAAGGTTGGGAAGCCCTGCAAAGTAAACTGGATGGCTTTCTCGCCGCCAAGGATCTGATGGCGCAGGGGATCAAGCTCTGATCAAGAGACAGGATG

AGGATCGTTTCGCATGATTGAACAAGATGGATTGCACGCAGGTTCTCCGGCCGCTTGGGTGGAGAGGCTATTCGGCTATGACTGGGCACAACAGACA

ATCGGCTGCTCTGATGCCGCCGTGTTCCGGCTGTCAGCGCAGGGGCGCCCGGTTCTTTTTGTCAAGACCGACCTGTCCGGTGCCCTGAATGAACTGC

AAGACGAGGCAGCGCGGCTATCGTGGCTGGCCACGACGGGCGTTCCTTGCGCAGCTGTGCTCGACGTTGTCACTGAAGCGGGAAGGGACTGGCTGCT

ATTGGGCGAAGTGCCGGGGCAGGATCTCCTGTCATCTCACCTTGCTCCTGCCGAGAAAGTATCCATCATGGCTGATGCAATGCGGCGGCTGCATACG

CTTGATCCGGCTACCTGCCCATTCGACCACCAAGCGAAACATCGCATCGAGCGAGCACGTACTCGGATGGAAGCCGGTCTTGTCGATCAGGATGATC

TGGACGAAGAGCATCAGGGGCTCGCGCCAGCCGAACTGTTCGCCAGGCTCAAGGCGAGCATGCCCGACGGCGAGGATCTCGTCGTGACCCATGGCGA

TGCCTGCTTGCCGAATATCATGGTGGAAAATGGCCGCTTTTCTGGATTCATCGACTGTGGCCGGCTGGGTGTGGCGGACCGCTATCAGGACATAGCG

TTGGCTACCCGTGATATTGCTGAAGAGCTTGGCGGCGAATGGGCTGACCGCTTCCTCGTGCTTTACGGTATCGCCGCTCCCGATTCGCAGCGCATCG

CCTTCTATCGCCTTCTTGACGAGTTCTTCTGAATTATTAACGCTTACAATTTCCTGATGCGGTATTTTCTCCTTACGCATCTGTGCGGTATTTCACA

CCGCATACAGGTGGCACTTTTCGGGGAAATGTGCGCGGAACCCCTATTTGTTTATTTTTCTAAATACATTCAAATATGTATCCGCTCATGAGACAAT

AACCCTGATAAATGCTTCAATAATAGCACGTGCTAAAACTTCATTTTTAATTTAAAAGGATCTAGGTGAAGATCCTTTTTGATAATCTCATGACCAA

AATCCCTTAACGTGAGTTTTCGTTCCACTGAGCGTCAGACCCCGTAGAAAAGATCAAAGGATCTTCTTGAGATCCTTTTTTTCTGCGCGTAATCTGC

TGCTTGCAAACAAAAAAACCACCGCTACCAGCGGTGGTTTGTTTGCCGGATCAAGAGCTACCAACTCTTTTTCCGAAGGTAACTGGCTTCAGCAGAG
```

-continued

```
CGCAGATACCAAATACTGTCCTTCTAGTGTAGCCGTAGTTAGGCCACCACTTCAAGAACTCTGTAGCACCGCCTACATACCTCGCTCTGCTAATCCT

GTTACCAGTGGCTGCTGCCAGTGGCGATAAGTCGTGTCTTACCGGGTTGGACTCAAGACGATAGTTACCGGATAAGGCGCAGCGGTCGGGCTGAACG

GGGGGTTCGTGCACACAGCCCAGCTTGGAGCGAACGACCTACACCGAACTGAGATACCTACAGCGTGAGCTATGAGAAAGCGCCACGCTTCCCGAAG

GGAGAAAGGCGGACAGGTATCCGGTAAGCGGCAGGGTCGGAACAGGAGAGCGCACGAGGGAGCTTCCAGGGGGAAACGCCTGGTATCTTTATAGTCC

TGTCGGGTTTCGCCACCTCTGACTTGAGCGTCGATTTTTGTGATGCTCGTCAGGGGGCGGAGCCTATGGAAAAACGCCAGCAACGCGGCCTTTTTACGGTT

CCTGGGCTTTTGCTGGCCTTTTGCTCACATGTTCTT
```

Complete Protein and Coding Sequence for Each CCR-5-Targeted TALEN:
To regenerate the sequence of each expression construct, replace the underlined region of the above construct with each CDS shown below.

>CCR5 L161 (+28)                                                                                (SEQ ID NO: 239)
```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIANNNGGKQA

LETVQRLLPVLCQDHGLTPEQVVAIASHDGGKQALETVQRLLPVLCQAHGLTPDQVVAIASNGGGKQALETVQRLLPVLCQAHGLTPAQVVAIANNN

GGKQALETVQRLLPVLCQDHGLTPDQVVAIANNNGGKQALETVQRLLPVLCQDHGLTPEQVVAIASNGGGKQALETVQRLLPVLCQAHGLTPDQVVA

IASHDGGKQALETVQRLLPVLCQAHGLTPAQVVAIASNIGGKQALETVQRLLPVLCQDHGLTPDQVVAIASNGGGKQALETVQRLLPVLCQDHGLTP

EQVVAIASHDGGKQALETVQRLLPVLCQAHGLTPDQVVAIASHDGGKQALETVQRLLPVLCQAHGLTPAQVVAIASNGGGKQALETVQRLLPVLCQD

HGLTPDQVVAIASHDGGKQALETVQRLLPVLCQDHGLTPAQVVAIASNIGGKQALETVQRLLPVLCQDHGLTPEQVVAIASNGGGRPALESIVAQLS

RPDPALAALTNDHLVALACLGGSQLVKSELEEKKSELRHKLKYVPHEYIELIEIARNSTQDRILEMKVMEFFMKVYGYRGKHLGGSRKPDGAIYTVG

SPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIK

AGTLTLEEVRRKFNNGEINFRS
```

> CCR5 L161 (+28)                                                                                (SEQ ID NO: 240)
```
ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCCAACAATAACGGGGGAAAGCAAGCC

CTGGAAACCGTGCAAAGGTTGTTGCCGGTCCTTTGTCAAGACCACGGCCTTACACCGGAGCAAGTCGTGGCCATTGCATCACATGACGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG

GAAACAAGCATTGGAGACTGTCCAACGGCTCCTTCCCGTGTTGTGTCAAGCCCACGGTTTGACGCCTGCACAAGTGGTCGCCATCGCCAACAACAAC

GGCGGTAAGCAGGCGCTGGAAACAGTACAGCGCCTGCTGCCTGTACTGTGCCAGGATCATGGACTCACCCCAGACCAGGTAGTCGCAATCGCCAACA

ATAACGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCCATGATGGAGGGAAACAAGCATTGGAGACTGTCCAACGGCTCCTTCCCGTGTTGTGTCAAGCCCACGGTTTGACGCCTGCACAAGTGG

TCGCCATCGCCTCCAATATTGGCGGTAAGCAGGCGCTGGAAACAGTACAGCGCCTGCTGCCTGTACTGTGCCAGGATCATGGGCTGACCCCAGACCA

GGTAGTCGCAATCGCGTCGAATGGCGGGGAAAGCAAGCCCTGGAAACCGTGCAAAGGTTGTTGCCGGTCCTTTGTCAAGACCACGGCCTTACACCG

GAGCAAGTCGTGGCCATTGCATCACATGACGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCCATGATGGAGGGAAACAAGCATTGGAGACTGTCCAACGGCTCCTTCCCGTGTTGTGTCAAGCCCACG

TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
```

```
CATGGTTTGACCCCAGACCAGGTAGTCGCAATCGCGTCGCATGACGGGGGAAAGCAAGCCCTGGAAACCGTGCAAAGGTTGTTGCCGGTCCTTTGTC
AAGACCACGGCCTTACGCCTGCACAAGTGGTCGCCATCGCCTCCAATATTGGCGGTAAGCAGGCGCTGGAAACAGTACAGCGCCTGCTGCCTGTACT
GTGCCAGGATCATGGCCTGACACCCGAACAGGTGGTCGCCATTGCTAGCAACGGGGGAGGACGGCCAGCCTTGGAGTCCATCGTAGCCCAATTGTCC
AGGCCCGATCCCGCGTTGGCTGCGTTAACGAATGACCATCTGGTGGCGTTGGCATGTCTTGGTGGATCCCAGCTGGTGAAGAGCGAGCTGGAGGAGA
AGAAGTCCGAGCTGCGGCACAAGCTGAAGTACGTGCCCCACGAGTACATCGAGCTGATCGAGATCGCCAGGAACAGCACCCAGGACCGCATCCTGGA
GATGAAGGTGATGGAGTTCTTCATGAAGGTGTACGGCTACAGGGGAAAGCACCTGGGCGGAAGCAGAAAGCCTGACGGCGCCATCTATACAGTGGGC
AGCCCCATCGATTACGGCGTGATCGTGGACACAAAGGCCTACAGCGGCGGCTACAATCTGCCTATCGGCCAGGCCGACGAGATGCAGAGATACGTGG
AGGAGAACCAGACCCGGAATAAGCACATCAACCCCAACGAGTGGTGGAAGGTGTACCCTAGCAGCGTGACCGAGTTCAAGTTCCTGTTCGTGAGCGG
CCACTTCAAGGGCAACTACAAGGCCCAGCTGACCAGGCTGAACCACATCACCAACTGCAATGGCGCCGTGCTGAGCGTGGAGGAGCTGCTGATCGGC
GGCGAGATGATCAAAGCCGGCACCCTGACACTGGAGGAGGTGCGGCGCAAGTTCAACAACGGCGAGATCAACTTCAGATCT

> CCR5 L161 (+63)                                                                                    (SEQ ID NO: 241)
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIANNNGGKQA
LETVQRLLPVLCQDHGLTPEQVVAIASHDGGKQALETVQRLLPVLCQAHGLTPDQVVAIASNGGGKQALETVQRLLPVLCQAHGLTPAQVVAIANNN
GGKQALETVQRLLPVLCQDHGLTPDQVVAIANNNGGKQALETVQRLLPVLCQAHGLTPEQVVAIASNGGGKQALETVQRLLPVLCQAHGLTPDQVVA
IASHDGGKQALETVQRLLPVLCQAHGLTPAQVVAIASNIGGKQALETVQRLLPVLCQDHGLTPDQVVAIASNGGGKQALETVQRLLPVLCQDHGLTP
EQVVAIASHDGGKQALETVQRLLPVLCQAHGLTPDQVVAIASHDGGKQALETVQRLLPVLCQAHGLTPAQVVAIASNGGGKQALETVQRLLPVLCQD
HGLTPDQVVAIASHDGGKQALETVQRLLPVLCQDHGLTPAQVVAIASNIGGKQALETVQRLLPVLCQDHGLTPEQVVAIASNGGGRPALESIVAQLS
RPDPALAALTNDHLVALACLGGRPALDAVKKGLPHAPALIKRTNRRIPERTSHRVAGSQLVKSELEEKKSELRHKLKYVPHEYIELIEIARNSTQDR
ILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLF
VSGHFKGNYKAQLTRLNHITNCNGAVLSVEELLIGGEMIKAGTLTLEEVRRKFNNGEINFRS

> CCR5 L161 (+63)                                                                                    (SEQ ID NO: 242)
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGAGTAACAGCGGTAGAGGC
AGTGCACGCCTGGCGCAATGCGCTCACCGGGGCCCCCTTGAACCTGACCCCAGACCAGGTAGTCGCAATCGCCAACAATAACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCACATGACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGTTTGACGCCTGCACAAGTGGTCGCCATCGCCAACAACAAC
GGCGGTAAGCAGGCGCTGGAAACAGTACAGCGCCTGCTGCCTGTACTGTGCCAGGATCATGGACTCACCCCAGACCAGGTAGTCGCAATCGCCAACA
ATAACGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCCATGATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCAATATTGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAATGGCGGGGAAAGCAAGCCCTGGAAACCGTGCAAAGGTTGTTGCCGGTCCTTTGTCAAGACCACGGCCTTACACCG
GAGCAAGTCGTGGCCATTGCATCACATGACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCCATGATGGAGGGAAACAAGCATTGGAGACTGTCCAACGGCTCCTTCCCGTGTTGTGTCAAGCCCACG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
```

-continued

```
CATGGTTTGACCCCAGACCAGGTAGTCGCAATCGCGTCGCATGACGGGGAAAGCAAGCCCTGGAAACCGTGCAAAGGTTGTTGCCGGTCCTTTGTC
AAGACCACGGCCTTACGCCTGCACAAGTGGTCGCCATCGCCTCCAATATTGGCGGTAAGCAGGCGCTGGAAACAGTACAGCGCCTGCTGCCTGTACT
GTGCCAGGATCATGGCCTGACACCCGAACAGGTGGTCGCCATTGCTAGCAACGGGGAGGACGGCCAGCCTTGGAGTCCATCGTAGCCCAATTGTCC
AGGCCCGATCCCGCGTTGGCTGCGTTAACGAATGACCATCTGGTGGCGTTGGCATGTCTTGGTGGACGACCCGCGCTCGATGCAGTCAAAAAGGGTC
TGCCTCATGCTCCCGCATTGATCAAAAGAACCAACCGGCGGATTCCCGAGAGAACTTCCCATCGAGTCGCGGGATCCCAGCTGGTGAAGAGCGAGCT
GGAGGAGAAGAAGTCCGAGCTGCGGCACAAGCTGAAGTACGTGCCCCACGAGTACATCGAGCTGATCGAGATCGCCAGGAACAGCACCCAGGACCGC
ATCCTGGAGATGAAGGTGATGGAGTTCTTCATGAAGGTGTACGGCTACAGGGGAAAGCACCTGGGCGGAAGCAGAAAGCCTGACGGCGCCATCTATA
CAGTGGGCAGCCCCATCGATTACGGCGTGATCGTGGACACAAAGGCCTACAGCGGCGGCTACAATCTGCCTATCGGCCAGGCCGACGAGATGCAGAG
ATACGTGGAGGAGAACCAGACCCGGAATAAGCACATCAACCCCAACGAGTGGTGGAAGGTGTACCCTAGCAGCGTGACCGAGTTCAAGTTCCTGTTC
GTGAGCGGCCACTTCAAGGGCAACTACAAGGCCCAGCTGACCAGGCTGAACCACATCACCAACTGCAATGGCGCCGTGCTGAGCGTGGAGGAGCTGC
TGATCGGCGGCGAGATGATCAAAGCCGGCACCCTGACACTGGAGGAGGTGCGGCGCAAGTTCAACAACGGCGAGATCAACTTCAGATCT
```

> CCR5 L164 (+28) (SEQ ID NO: 243)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIANNNGGKQA
LETVQRLLPVLCQDHGLTPDQVVAIANNNGGKQALETVQRLLPVLCQAHGLTPDQVVAIASNGGGKQALETVQRLLPVLCQAHGLTPAQVVAIASHD
GGKQALETVQRLLPVLCQDHGLTPDQVVAIASNIGGKQALETVQRLLPVLCQDHGLTPEQVVAIASNGGGKQALETVQRLLPVLCQAHGLTPDQVVA
IASHDGGKQALETVQRLLPVLCQAHGLTPAQVVAIASHDGGKQALETVQRLLPVLCQDHGLTPDQVVAIASNGGGKQALETVQRLLPVLCQDHGLTP
EQVVAIASHDGGKQALETVQRLLPVLCQAHGLTPDQVVAIASNIGGKQALETVQRLLPVLCQAHGLTPAQVVAIASNGGGKQALETVQRLLPVLCQD
HGLTPDQVVAIASHDGGKQALETVQRLLPVLCQDHGLTPAQVVAIASHDGGKQALETVQRLLPVLCQDHGLTPEQVVAIASNGGGRPALESIVAQLS
RPDPALAALTNDHLVALACLGGSQLVKSELEEKKSELRHKLKYVPHEYIELIEIARNSTQDRILEMKVMEFFMKVYGYRGKHLGGSRKPDGAIYTVG
SPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIG
GEMIKAGTLTLEEVRRKFNNGEINFRS
```

> CCR5 L164 (+28) (SEQ ID NO: 244)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGAGTAACAGCGGTAGAGGC
AGTGCACGCCTGGCGCAATGCGCTCACCGGGGCCCCCTTGAACCTGACCCCAGACCAGGTAGTCGCAATCGCCAACAATAACGGGGGAAAGCAAGCC
CTGGAAACCGTGCAAAGGTTGTTGCCGGTCCTTTGTCAAGACCACGGCCTTACACCGGATCAAGTCGTGGCCATTGCAAATAATAACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGGTTTGACGCCTGCACAAGTGGTCGCCATCGCCTCCCACGAC
GGCGGTAAGCAGGCGCTGGAAACAGTACAGCGCCTGCTGCCTGTACTGTGCCAGGACCATGGACTCACCCCAGACCAGGTAGTCGCAATCGCGTCGA
ACATTGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCCATGATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCCACGACGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAATGCGGGGGAAAGCAAGCCCTGGAAACCGTGCAAAGGTTGTTGCCGGTCCTTTGTCAAGACCACGGCCTTACACCG
GAGCAAGTCGTGGCCATTGCATCACATGACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCAACATCGGAGGGAAACAAGCATTGGAGACTGTCCAACGGCTCCTTCCCGTGTTGTGTCAAGCCCACGG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
```

-continued

```
CATGGTTTGACCCCAGACCAGGTAGTCGCAATCGCGTCGCATGACGGGGGAAAGCAAGCCCTGGAAACCGTGCAAAGGTTGTTGCCGGTCCTTTGTC

AAGACCACGGCCTTACGCCTGCACAAGTGGTCGCCATCGCCTCCCACGACGGCGGTAAGCAGGCGCTGGAAACAGTACAGCGCCTGCTGCCTGTACT

GTGCCAGGATCATGGCCTGACACCCGAACAGGTGGTCGCCATTGCTAGCAACGGGGGAGGACGGCCAGCCTTGGAGTCCATCGTAGCCCAATTGTCC

AGGCCCGATCCCGCGTTGGCTGCGTTAACGAATGACCATCTGGTGGCGTTGGCATGTCTTGGTGGATCCCAGCTGGTGAAGAGCGAGCTGGAGGAGA

AGAAGTCCGAGCTGCGGCACAAGCTGAAGTACGTGCCCCACGAGTACATCGAGCTGATCGAGATCGCCAGGAACAGCACCCAGGACCGCATCCTGGA

GATGAAGGTGATGGAGTTCTTCATGAAGGTGTACGGCTACAGGGGAAAGCACCTGGGCGGAAGCAGAAAGCCTGACGGCGCCATCTATACAGTGGGC

AGCCCCATCGATTACGGCGTGATCGTGGACACAAAGGCCTACAGCGGCGGCTACAATCTGCCTATCGGCCAGGCCGACGAGATGCAGAGATACGTGG

AGGAGAACCAGACCCGGAATAAGCACATCAACCCCAACGAGTGGTGGAAGGTGTACCCTAGCAGCGTGACCGAGTTCAAGTTCCTGTTCGTGAGCGG

CCACTTCAAGGGCAACTACAAGGCCCAGCTGACCAGGCTGAACCACATCACCAACTGCAATGGCGCCGTGCTGAGCGTGGAGGAGCTGCTGATCGGC

GGCGAGATGATCAAAGCCGGCACCCTGACACTGGAGGAGGTGCGGCGCAAGTTCAACAACGGCGAGATCAACTTCAGATCT
```

> CCR5 L164 (+63) (SEQ ID NO: 245)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIANNNGGKQA
LETVQRLLPVLCQDHGLTPDQVVAIANNNGGKQALETVQRLLPVLCQAHGLTPDQVVAIASNGGGKQALETVQRLLPVLCQAHGLTPAQVVAIASHD
GGKQALETVQRLLPVLCQDHGLTPDQVVAIASNIGGKQALETVQRLLPVLCQDHGLTPEQVVAIASNGGGKQALETVQRLLPVLCQAHGLTPDQVVA
IASHDGGKQALETVQRLLPVLCQAHGLTPAQVVAIASHDGGKQALETVQRLLPVLCQDHGLTPDQVVAIASNGGGKQALETVQRLLPVLCQDHGLTP
EQVVAIASHDGGKQALETVQRLLPVLCQAHGLTPDQVVAIASNIGGKQALETVQRLLPVLCQAHGLTPAQVVAIASNGGGKQALETVQRLLPVLCQD
HGLTPDQVVAIASHDGGKQALETVQRLLPVLCQDHGLTPAQVVAIASHDGGKQALETVQRLLPVLCQDHGLTPEQVVAIASNGGGRPALESIVAQLS
RPDPALAALTNDHLVALACLGGRPALDAVKKGLPHAPALIKRTNRRIPERTSHRVAGSQLVKSELEEKKSELRHKLKYVPHEYIELIEIARNSTQDR
ILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLF
VSGHFKGNYKAQLTRLNHITNCNGAVLSVEELLIGGEMIKAGTLTLEEVRRKFNNGEINFRS
```

>CCR5 L164 (+63) (SEQ ID NO: 246)

```
ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCCAACAATAACGGGGGAAAGCAAGCC

CTGGAAACCGTGCAAAGGTTGTTGCCGGTCCTTTGTCAAGACCACGGCCTTACACCGGATCAAGTCGTGGCCATTGCAAATAATAACGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG

GAAACAAGCATTGGAGACTGTCCAACGGCTCCTTCCCGTGTTGTGTCAAGCCCACGGTTTGACGCCTGCACAAGTGGTCGCCATCGCCTCCCACGAC

GGCGGTAAGCAGGCGCTGGAAACAGTACAGCGCCTGCTGCCTGTACTGTGCCAGGATCATGGACTCACCCCAGACCAGGTAGTCGCAATCGCGTCGA

ACATTGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCCATGATGGAGGGAAACAAGCATTGGAGACTGTCCAACGGCTCCTTCCCGTGTTGTGTCAAGCCCACGGTTTGACGCCTGCACAAGTGG

TCGCCATCGCCTCCCACGACGGCGGTAAGCAGGCGCTGGAAACAGTACAGCGCCTGCTGCCTGTACTGTGCCAGGATCATGGGCTGACCCCAGACCA

GGTAGTCGCAATCGCGTCGAATGGCGGGGAAAGCAAGCCCTGGAAACCGTGCAAAGGTTGTTGCCGGTCCTTTGTCAAGACCACGGCCTTACACCG

GAGCAAGTCGTGGCCATTGCATCACATGACGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCAACATCGGAGGGAAACAAGCATTGGAGACTGTCCAACGGCTCCTTCCCGTGTTGTGTCAAGCCCACG

TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
```

-continued

CATGGTTTGACCCCAGACCAGGTAGTCGCAATCGCGTCGCATGACGGGGAAAGCAAGCCCTGGAAACCGTGCAAAGGTTGTTGCCGGTCCTTTGTC

AAGACCACGGCCTTACGCCTGCACAAGTGGTCGCCATCGCCTCCCACGACGGCGGTAAGCAGGCGCTGGAAACAGTACAGCGCCTGCTGCCTGTACT

GTGCCAGGATCATGGCCTGACACCCGAACAGGTGGTCGCCATTGCTAGCAACGGGGAGGACGGCCAGCCTTGGAGTCCATCGTAGCCCAATTGTCC

AGGCCCGATCCCGCGTTGGCTGCGTTAACGAATGACCATCTGGTGGCGTTGGCATGTCTTGGTGGACGACCCGCGCTCGATGCAGTCAAAAAGGGTC

TGCCTCATGCTCCCGCATTGATCAAAAGAACCAACCGGCGGATTCCCGAGAGAACTTCCCATCGAGTCGCGGGATCCCAGCTGGTGAAGAGCGAGCT

GGAGGAGAAGAAGTCCGAGCTGCGGCACAAGCTGAAGTACGTGCCCCACGAGTACATCGAGCTGATCGAGATCGCCAGGAACAGCACCCAGGACCGC

ATCCTGGAGATGAAGGTGATGGAGTTCTTCATGAAGGTGTACGGCTACAGGGGAAAGCACCTGGGCGGAAGCAGAAAGCCTGACGGCGCCATCTATA

CAGTGGGCAGCCCCATCGATTACGGCGTGATCGTGGACACAAAGGCCTACAGCGGCGGCTACAATCTGCCTATCGGCCAGGCCGACGAGATGCAGAG

ATACGTGGAGGAGAACCAGACCCGGAATAAGCACATCAACCCCAACGAGTGGTGGAAGGTGTACCCTAGCAGCGTGACCGAGTTCAAGTTCCTGTTC

GTGAGCGGCCACTTCAAGGGCAACTACAAGGCCCAGCTGACCAGGCTGAACCACATCACCAACTGCAATGGCGCCGTGCTGAGCGTGGAGGAGCTGC

TGATCGGCGGCGAGATGATCAAAGCCGGCACCCTGACACTGGAGGAGGTGCGGCGCAAGTTCAACAACGGCGAGATCAACTTCAGATCT

> CCR5 L167 (+28)

(SEQ ID NO: 247)

MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIASHDGGKQA

LETVQRLLPVLCQDHGLTPEQVVAIASNIGGKQALETVQRLLPVLCQAHGLTPDQVVAIASNGGGKQALETVQRLLPVLCQAHGLTPAQVVAIASHD

GGKQALETVQRLLPVLCQDHGLTPDQVVAIASHDGGKQALETVQRLLPVLCQDHGLTPEQVVAIASNGGGKQALETVQRLLPVLCQAHGLTPDQVVA

IASHDGGKQALETVQRLLPVLCQAHGLTPAQVVAIASNIGGKQALETVQRLLPVLCQDHGLTPDQVVAIASNGGGKQALETVQRLLPVLCQDHGLTP

EQVVAIASHDGGKQALETVQRLLPVLCQAHGLTPDQVVAIASHDGGKQALETVQRLLPVLCQAHGLTPAQVVAIASNGGGKQALETVQRLLPVLCQD

HGLTPDQVVAIANNNGGKQALETVQRLLPVLCQDHGLTPAQVVAIASNIGGKQALETVQRLLPVLCQDHGLTPEQVVAIASNGGGRPALESIVAQLS

RPDPALAALTNDHLVALACLGGSQLVKSELEEKKSELRHKLKYVPHEYIELIEIARNSTQDRILEMKVMEFFMKVYGYRGKHLGGSRKPDGAIYTVG

SPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIG

GEMIKAGTLTLEEVRRKFNNGEINFRS

> CCR5 L167 (+28)

(SEQ ID NO: 248)

ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCGTCGCATGACGGGGAAAGCAAGCC

CTGGAAACCGTGCAAAGGTTGTTGCCGGTCCTTTGTCAAGACCACGGCCTTACACCGGAGCAAGTCGTGGCCATTGCATCAAATATCGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG

GAAACAAGCATTGGAGACTGTCCAACGGCTCCTTCCCGTGTTGTGTCAAGCCCACGGTTTGACGCCTGCACAAGTGGTCGCCATCGCCTCCCACGAC

GGCGGTAAGCAGGCGCTGGAAACAGTACAGCGCCTGCTGCCTGTACTGTGCCAGGATCATGGACTCACCCCAGACCAGGTAGTCGCAATCGCGTCGC

ATGACGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCCATGATGGAGGGAAACAAGCATTGGAGACTGTCCAACGGCTCCTTCCCGTGTTGTGTCAAGCCCACGGTTTGACGCCTGCACAAGTGG

TCGCCATCGCCTCCAATATTGGCGGTAAGCAGGCGCTGGAAACAGTACAGCGCCTGCTGCCTGTACTGTGCCAGGATCATGGGCTGACCCCAGACCA

GGTAGTCGCAATCGCGTCGAATGGCGGGGAAAGCAAGCCCTGGAAACCGTGCAAAGGTTGTTGCCGGTCCTTTGTCAAGACCACGGCCTTACACCG

GAGCAAGTCGTGGCCATTGCATCACATGACGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCCATGATGGAGGGAAACAGGCATTGGAGACTGTCCAACGGCTCCTTCCCGTGTTGTGTCAAGCCCACG

TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT

```
CATGGTTTGACCCCAGACCAGGTAGTCGCAATCGCCAACAATAACGGGGGAAAGCAAGCCCTGGAAACCGTGCAAAGGTTGTTGCCGGTCCTTTGTC

AAGACCACGGCCTTACGCCTGCACAAGTGGTCGCCATCGCCTCCAATATTGGCGGTAAGCAGGCGCTGGAAACAGTACAGCGCCTGCTGCCTGTACT

GTGCCAGGATCATGGCCTGACACCCGAACAGGTGGTCGCCATTGCTAGCAACGGGGGAGGACGGCCAGCCTTGGAGTCCATCGTAGCCCAATTGTCC

AGGCCCGATCCCGCGTTGGCTGCGTTAACGAATGACCATCTGGTGGCGTTGGCATGTCTTGGTGGATCCCAGCTGGTGAAGAGCGAGCTGGAGGAGA

AGAAGTCCGAGCTGCGGCACAAGCTGAAGTACGTGCCCCACGAGTACATCGAGCTGATCGAGATCGCCAGGAACAGCACCCAGGACCGCATCCTGGA

GATGAAGGTGATGGAGTTCTTCATGAAGGTGTACGGCTACAGGGGAAAGCACCTGGGCGGAAGCAGAAAGCCTGACGGCGCCATCTATACAGTGGGC

AGCCCCATCGATTACGGCGTGATCGTGGACACAAAGGCCTACAGCGGCGGCTACAATCTGCCTATCGGCCAGGCCGACGAGATGCAGAGATACGTGG

AGGAGAACCAGACCCGGAATAAGCACATCAACCCCAACGAGTGGTGGAAGGTGTACCCTAGCAGCGTGACCGAGTTCAAGTTCCTGTTCGTGAGCGG

CCACTTCAAGGGCAACTACAAGGCCCAGCTGACCAGGCTGAACCACATCACCAACTGCAATGGCGCCGTGCTGAGCGTGGAGGAGCTGCTGATCGGC

GGCGAGATGATCAAAGCCGGCACCCTGACACTGGAGGAGGTGCGGCGCAAGTTCAACAACGGCGAGATCAACTTCAGATCT

> CCR5 L167 (+63)                                                                                                (SEQ ID NO: 249)
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIASHDGGKQA

LETVQRLLPVLCQDHGLTPEQVVAIASNIGGKQALETVQRLLPVLCQAHGLTPDQVVAIASNGGGKQALETVQRLLPVLCQAHGLTPAQVVAIASHD

GGKQALETVQRLLPVLCQDHGLTPDQVVAIASHDGGKQALETVQRLLPVLCQDHGLTPEQVVAIASNGGGKQALETVQRLLPVLCQAHGLTPDQVVA

IASHDGGKQALETVQRLLPVLCQAHGLTPAQVVAIASNIGGKQALETVQRLLPVLCQDHGLTPDQVVAIASNGGGKQALETVQRLLPVLCQDHGLTP

EQVVAIASHDGGKQALETVQRLLPVLCQAHGLTPDQVVAIASHDGGKQALETVQRLLPVLCQAHGLTPAQVVAIASNGGGKQALETVQRLLPVLCQD

HGLTPDQVVAIANNNGGKQALETVQRLLPVLCQDHGLTPAQVVAIASNIGGKQALETVQRLLPVLCQDHGLTPEQVVAIASNGGGRPALESIVAQLS

RPDPALAALTNDHLVALACLGGRPALDAVKKGLPHAPALIKRTNRRIPERTSHRVAGSQLVKSELEEKKSELRHKLKYVPHEYIELIEIARNSTQDR

ILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLF

VSGHFKGNYKAQLTRLNHITNCNGAVLSVEELLIGGEMIKAGTLTLEEVRRKFNNGEINFRS

> CCR5 L167 (+63)                                                                                                (SEQ ID NO: 250)
ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGAGTAACAGCGGTAGAGGC

AGTGCACGCCTGGCGCAATGCGCTCACCGGGGCCCCCTTGAACCTGACCCCAGACCAGGTAGTCGCAATCGCGTCGCATGACGGGGGAAAGCAAGCC

CTGGAAACCGTGCAAAGGTTGTTGCCGGTCCTTTGTCAAGACCACGGCCTTACACCGGAGCAAGTCGTGGCCATTGCATCAAATATCGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG

GAAACAAGCATTGGAGACTGTCCAACGGCTCCTTCCCGTGTTGTGTCAAGCCCACGTTTGACGCCTGCACAAGTGGTCGCCATCGCCTCCCACGAC

GGCGGTAAGCAGGCGCTGGAAACAGTACAGCGCCTGCTGCCTGTACTGTGCCAGGATCATGGACTCACCCCAGACCAGGTAGTCGCAATCGCGTCGC

ATGACGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCCATGATGGAGGGAAACAAGCATTGGAGACTGTCCAACGGCTCCTTCCCGTGTTGTGTCAAGCCCACGGTTTGACGCCTGCACAAGTGG

TCGCCATCGCCTCCAATATTGGCGGTAAGCAGGCGCTGGAAACAGTACAGCGCCTGCTGCCTGTACTGTGCCAGGATCATGGGCTGACCCCAGACCA

GGTAGTCGCAATCGCGTCGAATGGCGGGGAAAGCAAGCCCTGGAAACCGTGCAAAGGTTGTTGCCGGTCCTTTGTCAAGACCACGGCCTTACACCG

GAGCAAGTCGTGGCCATTGCATCACATGACGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCCATGATGGAGGGAAACAAGCATTGGAGACTGTCCAACGGCTCCTTCCCGTGTTGTGTCAAGCCCACG

TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
```

-continued

CATGGTTTGACCCCAGACCAGGTAGTCGCAATCGCCAACAATAACGGGGAAAGCAAGCCCTGGAAACCGTGCAAAGGTTGTTGCCGGTCCTTTGTC
AAGACCACGGCCTTACGCCTGCACAAGTGGTCGCCATCGCCTCCAATATTGGCGGTAAGCAGGCGCTGGAAACAGTACAGCGCCTGCTGCCTGTACT
GTGCCAGGATCATGGCCTGACACCCGAACAGGTGGTCGCCATTGCTAGCAACGGGGAGGACGGCCAGCCTTGGAGTCCATCGTAGCCCAATTGTCC
AGGCCCGATCCCGCGTTGGCTGCGTTAACGAATGACCATCTGGTGGCGTTGGCATGTCTTGGTGGACGACCCGCGCTCGATGCAGTCAAAAAGGGTC
TGCCTCATGCTCCCGCATTGATCAAAAGAACCAACCGGCGGATTCCCGAGAGAACTTCCCATCGAGTCGCGGGATCCCAGCTGGTGAAGAGCGAGCT
GGAGGAGAAGAAGTCCGAGCTGCGGCACAAGCTGAAGTACGTGCCCCACGAGTACATCGAGCTGATCGAGATCGCCAGGAACAGCACCCAGGACCGC
ATCCTGGAGATGAAGGTGATGGAGTTCTTCATGAAGGTGTACGGCTACAGGGGAAAGCACCTGGGCGGAAGCAGAAAGCCTGACGGCGCCATCTATA
CAGTGGGCAGCCCCATCGATTACGGCGTGATCGTGGACACAAAGGCCTACAGCGGCGGCTACAATCTGCCTATCGGCCAGGCCGACGAGATGCAGAG
ATACGTGGAGGAGAACCAGACCCGGAATAAGCACATCAACCCCAACGAGTGGTGGAAGGTGTACCCTAGCAGCGTGACCGAGTTCAAGTTCCTGTTC
GTGAGCGGCCACTTCAAGGGCAACTACAAGGCCCAGCTGACCAGGCTGAACCACATCACCAACTGCAATGGCGCCGTGCTGAGCGTGGAGGAGCTGC
TGATCGGCGGCGAGATGATCAAAGCCGGCACCCTGACACTGGAGGAGGTGCGGCGCAAGTTCAACAACGGCGAGATCAACTTCAGATCT

> CCR5 L172 (+28)
(SEQ ID NO: 251)
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASHDGGKQA
LETVQRLLPVLCQDHGLTPEQVVAIASHDGGKQALETVQRLLPVLCQAHGLTPDQVVAIASNGGGKQALETVQRLLPVLCQAHGLTPAQVVAIASHD
GGKQALETVQRLLPVLCQDHGLTPDQVVAIASNIGGKQALETVQRLLPVLCQDHGLTPEQVVAIASNGGGKQALETVQRLLPVLCQAHGLTPDQVVA
IASHDGGKQALETVQRLLPVLCQAHGLTPAQVVAIASHDGGKQALETVQRLLPVLCQDHGLTPDQVVAIASNGGGKQALETVQRLLPVLCQDHGLTP
DQVVAIANNNGGKQALETVQRLLPVLCQAHGLTPDQVVAIASNIGGKQALETVQRLLPVLCQAHGLTPAQVVAIASNGGGKQALETVQRLLPVLCQD
HGLTPDQVVAIASNIGGKQALETVQRLLPVLCQDHGLTPEQVVAIASNIGGKQALETVQRLLPVLCQAHGLTPDQVVAIASNIGGKQALETVQRLLP
VLCQAHGLTPAQVVAIASHDGGKQALETVQRLLPVLCQDHGLTPEQVVAIASNGGGRPALESIVAQLSRPDPALAALTNDHLVALACLGGSQLVKSE
LEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQ
RYVEENQTRNKHINPNEWWKVYPSSVTEFKFLFVSGHFKGNYKAQLTRLNHITNCNGAVLSVEELLIGGEMIKAGTLTLEEVARKFNNGEINFRS

> CCR5 L172 (+28)
(SEQ ID NO: 252)
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCGTCGCATGACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCACATGACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGGTTTGACGCCTGCACAAGTGGTCGCCATCGCCTCCCACGAC
GGCGGTAAGCAGGCGCTGGAAACAGTACAGCGCCTGCTGCCTGTACTGTGCCAGGATCATGGACTCACCCCAGACCAGGTAGTCGCAATCGCGTCGA
ACATTGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCCATGATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCCACGACGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAATGCGGGGGAAAGCAAGCCCTGGAAACCGTGCAAAGGTTGTTGCCGGTCCTTTGTCAAGACCACGGCCTTACACCG
GATCAAGTCGTGGCCATTGCAAATAATAACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCAACATCGGAGGGAAACAAGCATTGGAGACTGTCCAACGGCTCCTTCCCGTGTTGTGTCAAGCCCACG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT

CATGGTTTGACCCCAGACCAGGTAGTCGCAATCGCGTCGAACATTGGGGGAAAGCAAGCCCTGGAAACCGTGCAAAGGTTGTTGCCGGTCCTTTGTC
AAGACCACGGCCTTACACCGGAGCAAGTCGTGGCCATTGCATCTAATATCGGTGGCAAACAGGCTCTTGAGACGGTTCAGAGACTTCTCCCAGTTCT
CTGTCAAGCCCACGGGCTGACTCCCGATCAAGTTGTAGCGATTGCGAGCAACATCGGAGGGAAACAAGCATTGGAGACTGTCCAACGGCTCCTTCCC
GTGTTGTGTCAAGCCCACGGTTTGACGCCTGCACAAGTGGTCGCCATCGCCTCCCACGACGGCGGTAAGCAGGCGCTGGAAACAGTACAGCGCCTGC
TGCCTGTACTGTGCCAGGATCATGGCCTGACACCCGAACAGGTGGTCGCCATTGCTAGCAACGGGGAGGACGGCCAGCCTTGGAGTCCATCGTAGC
CCAATTGTCCAGGCCCGATCCCGCGTTGGCTGCGTTAACGAATGACCATCTGGTGGCGTTGGCATGTCTTGGTGGATCCCAGCTGGTGAAGAGCGAG
CTGGAGGAGAAGAAGTCCGAGCTGCGGCACAAGCTGAAGTACGTGCCCCACGAGTACATCGAGCTGATCGAGATCGCCAGGAACAGCACCCAGGACC
GCATCCTGGAGATGAAGGTGATGGAGTTCTTCATGAAGGTGTACGGCTACAGGGGAAAGCACCTGGGCGGAAGCAGAAAGCCTGACGGCGCCATCTA
TACAGTGGGCAGCCCCATCGATTACGGCGTGATCGTGGACACAAAGGCCTACAGCGGCGGCTACAATCTGCCTATCGGCCAGGCCGACGAGATGCAG
AGATACGTGGAGGAGAACCAGACCCGGAATAAGCACATCAACCCCAACGAGTGGTGGAAGGTGTACCCTAGCAGCGTGACCGAGTTCAAGTTCCTGT
TCGTGAGCGGCCACTTCAAGGGCAACTACAAGGCCCAGCTGACCAGGCTGAACCACATCACCAACTGCAATGGCGCCGTGCTGAGCGTGGAGGAGCT
GCTGATCGGCGGCGAGATGATCAAAGCCGGCACCCTGACACTGGAGGAGGTGCGGCGCAAGTTCAACAACGGCGAGATCAACTTCAGATCT

> CCR5 L172 (+63)                                                                                (SEQ ID NO: 253)
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASHDGGKQA
LETVQRLLPVLCQDHGLTPEQVVAIASHDGGKQALETVQRLLPVLCQAHGLTPDQVVAIASNGGGKQALETVQRLLPVLCQAHGLTPAQVVAIASHD
GGKQALETVQRLLPVLCQDHGLTPDQVVAIASNIGGKQALETVQRLLPVLCQDHGLTPEQVVAIASNGGGKQALETVQRLLPVLCQAHGLTPDQVVA
IASHDGGKQALETVQRLLPVLCQAHGLTPAQVVAIASHDGGKQALETVQRLLPVLCQDHGLTPDQVVAIASNGGGKQALETVQRLLPVLCQDHGLTP
DQVVAIANNNGGKQALETVQRLLPVLCQAHGLTPDQVVAIASNIGGKQALETVQRLLPVLCQAHGLTPAQVVAIASNGGGKQALETVQRLLPVLCQD
HGLTPDQVVAIASNIGGKQALETVQRLLPVLCQDHGLTPEQVVAIASNIGGKQALETVQRLLPVLCQAHGLTPDQVVAIASNIGGKQALETVQRLLP
VLCQAHGLTPAQVVAIASHDGGKQALETVQRLLPVLCQDHGLTPEQVVAIASNGGGRPALESIVAQLSRPDPALAALTNDHLVALACLGGRPALDAV
KKGLPHAPALIKRTNRRIPERTSHRVAGSQLVKSELEEKKSELRHKLKYVPHEYIELIEIARNSTQDRILEMKVMEFFMKVYGYRGKHLGGSRKPDG
AIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSV
EELLIGGEMIKAGTLTLEEVRRKFNNGEINFRS

> CCR5 L172 (+63)                                                                                (SEQ ID NO: 254)
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGAGTAACAGCGGTAGAGGC
AGTGCACGCCTGGCGCAATGCGCTCACCGGGGCCCCCTTGAACCTGACCCCAGACCAGGTAGTCGCAATCGCGTCGCATGACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCACATGACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGGTTTGACGCCTGCACAAGTGGTCGCCATCGCCTCCCACGAC
GGCGGTAAGCAGGCGCTGGAAACAGTACAGCGCCTGCTGCCTGTACTGTGCCAGGATCATGGACTCACCCCAGACCAGGTAGTCGCAATCGCGTCGA
ACATTGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCCATGATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCCACGACGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAATGGCGGGGGAAAGCAAGCCCTGGAAACCGTGCAAAGGTTGTTGCCGGTCCTTTGTCAAGACCACGGCCTTACACCG

-continued

```
GATCAAGTCGTGGCCATTGCAAATAATAACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCAACATCGGAGGGAAACAAGCATTGGAGACTGTCCAACGGCTCCTTCCCGTGTTGTGTCAAGCCCACGG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
CATGGTTTGACCCCAGACCAGGTAGTCGCAATCGCGTCGAACATTGGGGGAAAGCAAGCCCTGGAAACCGTGCAAAGGTTGTTGCCGGTCCTTTGTC
AAGACCACGGCCTTACACCGGAGCAAGTCGTGGCCATTGCATCTAATATCGGTGGCAAACAGGCTCTTGAGACGGTTCAGAGACTTCTCCCAGTTCT
CTGTCAAGCCCACGGGCTGACTCCCGATCAAGTTGTAGCGATTGCGAGCAACATCGGAGGGAAACAAGCATTGGAGACTGTCCAACGGCTCCTTCCC
GTGTTGTGTCAAGCCCACGGTTTGACGCCTGCACAAGTGGTCGCCATCGCCTCCCACGACGGCGGTAAGCAGGCGCTGGAAACAGTACAGCGCCTGC
TGCCTGTACTGTGCCAGGATCATGGCCTGACACCCGAACAGGTGGTCGCCATTGCTAGCAACGGGGGAGGACGGCCAGCCTTGGAGTCCATCGTAGC
CCAATTGTCCAGGCCCGATCCCGCGTTGGCTGCGTTAACGAATGACCATCTGGTGGCGTTGGCATGTCTTGGTGGACGACCCGCGCTCGATGCAGTC
AAAAAGGGTCTGCCTCATGCTCCCGCATTGATCAAAAGAACCAACCGGCGGATTCCCGAGAGAACTTCCCATCGAGTCGCGGGATCCCAGCTGGTGA
AGAGCGAGCTGGAGGAGAAGAAGTCCGAGCTGCGGCACAAGCTGAAGTACGTGCCCCACGAGTACATCGAGCTGATCGAGATCGCCAGGAACAGCAC
CCAGGACCGCATCCTGGAGATGAAGGTGATGGAGTTCTTCATGAAGGTGTACGGCTACAGGGGAAAGCACCTGGGCGGAAGCAGAAAGCCTGACGGC
GCCATCTATACAGTGGGCAGCCCCATCGATTACGGCGTGATCGTGGACACAAAGGCCTACAGCGGCGGCTACAATCTGCCTATCGGCCAGGCCGACG
AGATGCAGAGATACGTGGAGGAGAACCAGACCCGGAATAAGCACATCAACCCCAACGAGTGGTGGAAGGTGTACCCTAGCAGCGTGACCGAGTTCAA
GTTCCTGTTCGTGAGCGGCCACTTCAAGGGCAACTACAAGGCCCAGCTGACCAGGCTGAACCACATCACCAACTGCAATGGCGCCGTGCTGAGCGTG
GAGGAGCTGCTGATCGGCGGCGAGATGATCAAAGCCGGCACCCTGACACTGGAGGAGGTGCGGCGCAAGTTCAACAACGGCGAGATCAACTTCAGAT
CT
```

>CCR5 R175 (+28) (SEQ ID NO: 255)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIANNNGGKQA
LETVQRLLPVLCQDHGLTPEQVVAIASHDGGKQALETVQRLLPVLCQAHGLTPDQVVAIASNGGGKQALETVQRLLPVLCQAHGLTPAQVVAIASHD
GGKQALETVQRLLPVLCQDHGLTPDQVVAIASNGGGKQALETVQRLLPVLCQDHGLTPEQVVAIASNGGGKQALETVQRLLPVLCQAHGLTPDQVVA
IASHDGGKQALETVQRLLPVLCQAHGLTPAQVVAIASNIGGKQALETVQRLLPVLCQDHGLTPDQVVAIANNNGGKQALETVQRLLPVLCQDHGLTP
EQVVAIASHDGGKQALETVQRLLPVLCQAHGLTPDQVVAIASHDGGKQALETVQRLLPVLCQAHGLTPAQVVAIASNGGGKQALETVQRLLPVLCQD
HGLTPDQVVAIASNGGGKQALETVQRLLPVLCQDHGLTPAQVVAIASNGGGKQALETVQRLLPVLCQDHGLTPEQVVAIASNGGGRPALESIVAQLS
RPDPALAALTNDHLVALACLGGSQLVKSELEEKKSELRHKLKYVPHEYIELIEIARNSTQDRILEMKVMEFFMKVYGYRGKHLGGSRKPDGAIYTVG
SPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIG
GEMIKAGTLTLEEVRRKFNNGEINFRS
```

>CCR5 R175 (+28) (SEQ ID NO: 256)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGAGTAACAGCGGTAGAGGC
AGTGCACGCCTGGCGCAATGCGCTCACCGGGGCCCCCTTGAACCTGACCCCAGACCAGGTAGTCGCAATCGCCAACAATAACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCACATGACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGGTTTGACGCCTGCACAAGTGGTCGCCATCGCCTCCCACGAC
GGCGGTAAGCAGGCGCTGGAAACAGTACAGCGCCTGCTGCCTGTACTGTGCCAGGATCATGGACTCACCCCAGACCAGGTAGTCGCAATCGCGTCGA
ATGGCGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
```

-continued

```
ATTGCGAGCCATGATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCAATATTGGCGGTAAGCAGGCGCTGGAAACAGTACAGCGCCTGCTGCCTGTACTGTGCCAGGATCATGGGCTGACCCCAGACCA
GGTAGTCGCAATCGCCAACAATAACGGGGGAAAGCAAGCCCTGGAAACCGTGCAAAGGTTGTTGCCGGTCCTTTGTCAAGACCACGGCCTTACACCG
GAGCAAGTCGTGGCCATTGCATCACATGACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCCATGATGGAGGGAAACAAGCATTGGAGACTGTCCAACGGCTCCTTCCCGTGTTGTGTCAAGCCCACGG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
CATGGTTTGACCCCAGACCAGGTAGTCGCAATCGCGTCGAATGGCGGGGAAAGCAAGCCCTGGAAACCGTGCAAAGGTTGTTGCCGGTCCTTTGTC
AAGACCACGGCCTTACGCCTGCACAAGTGGTCGCCATCGCCTCCAACGGTGGCGGTAAGCAGGCGCTGGAAACAGTACAGCGCCTGCTGCCTGTACT
GTGCCAGGATCATGGCCTGACACCCGAACAGGTGGTCGCCATTGCTAGCAACGGGGAGGACGGCCAGCCTTGGAGTCCATCGTAGCCCAATTGTCC
AGGCCCGATCCCGCGTTGGCTGCGTTAACGAATGACCATCTGGTGGCGTTGGCATGTCTTGGTGGATCCCAGCTGGTGAAGAGCGAGCTGGAGGAGA
AGAAGTCCGAGCTGCGGCACAAGCTGAAGTACGTGCCCCACGAGTACATCGAGCTGATCGAGATCGCCAGGAACAGCACCCAGGACCGCATCCTGGA
GATGAAGGTGATGGAGTTCTTCATGAAGGTGTACGGCTACAGGGGAAAGCACCTGGGCGGAAGCAGAAAGCCTGACGGCGCCATCTATACAGTGGGC
AGCCCCATCGATTACGGCGTGATCGTGGACACAAAGGCCTACAGCGGCGGCTACAATCTGCCTATCGGCCAGGCCGACGAGATGCAGAGATACGTGG
AGGAGAACCAGACCCGGAATAAGCACATCAACCCCAACGAGTGGTGGAAGGTGTACCCTAGCAGCGTGACCGAGTTCAAGTTCCTGTTCGTGAGCGG
CCACTTCAAGGGCAACTACAAGGCCCAGCTGACCAGGCTGAACCACATCACCAACTGCAATGGCGCCGTGCTGAGCGTGGAGGAGCTGCTGATCGGC
GGCGAGATGATCAAAGCCGGCACCCTGACACTGGAGGAGGTGCGGCGCAAGTTCAACAACGGCGAGATCAACTTCAGATCT
```

> CCR5 R175 (+63) (SEQ ID NO: 257)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIANNNGGKQA
LETVQRLLPVLCQDHGLTPEQVVAIASHDGGKQALETVQRLLPVLCQAHGLTPDQVVAIASNGGGKQALETVQRLLPVLCQAHGLTPAQVVAIASHD
GGKQALETVQRLLPVLCQDHGLTPDQVVAIASNGGGKQALETVQRLLPVLCQDHGLTPEQVVAIASNGGGKQALETVQRLLPVLCQAHGLTPDQVVA
IASHDGGKQALETVQRLLPVLCQAHGLTPAQVVAIASNIGGKQALETVQRLLPVLCQDHGLTPDQVVAIANNNGGKQALETVQRLLPVLCQDHGLTP
EQVVAIASHDGGKQALETVQRLLPVLCQAHGLTPDQVVAIASHDGGKQALETVQRLLPVLCQAHGLTPAQVVAIASNGGGKQALETVQRLLPVLCQD
HGLTPDQVVAIASNGGGKQALETVQRLLPVLCQDHGLTPAQVVAIASNGGGKQALETVQRLLPVLCQDHGLTPEQVVAIASNGGGRPALESIVAQLS
RPDPALAALTNDHLVALACLGGRPALDAVKKGLPHAPALIKRTNRRIPERTSHRVAGSQLVKSELEEKKSELRHKLKYVPHEYIELIEIARNSTQDR
ILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLF
VSGHFKGNYKAQLTRLNHITNCNGAVLSVEELLIGGEMIKAGTLTLEEVRRKFNNGEINFRS
```

> CCR5 R175 (+63) (SEQ ID NO: 258)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCCAACAATAACGGGGAAAGCAAGCC
CTGGAAACCGTGCAAAGGTTGTTGCCGGTCCTTTGTCAAGACCACGGCCTTACACCGGAGCAAGTCGTGGCCATTGCATCACATGACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGGTTTGACGCCTGCACAAGTGGTCGCCATCGCCTCCCACGAC
GGCGGTAAGCAGGCGCTGGAAACAGTACAGCGCCTGCTGCCTGTACTGTGCCAGGATCATGGACTCACCCCAGACCAGGTAGTCGCAATCGCGTCGA
ATGGCGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
```

```
ATTGCGAGCCATGATGGAGGGAAACAAGCATTGGAGACTGTCCAACGGCTCCTTCCCGTGTTGTGTCAAGCCCACGGTTTGACGCCTGCACAAGTGG

TCGCCATCGCCTCCAATATTGGCGGTAAGCAGGCGCTGGAAACAGTACAGCGCCTGCTGCCTGTACTGTGCCAGGATCATGGGCTGACCCCAGACCA

GGTAGTCGCAATCGCCAACAATAACGGGGGAAAGCAAGCCCTGGAAACCGTGCAAAGGTTGTTGCCGGTCCTTTGTCAAGACCACGGCCTTACACCG

GAGCAAGTCGTGGCCATTGCATCACATGACGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCCATGATGGAGGGAAACAAGCATTGGAGACTGTCCAACGGCTCCTTCCCGTGTTGTGTCAAGCCCACGG

TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT

CATGGTTTGACCCCAGACCAGGTAGTCGCAATCGCGTCGAATGGCGGGGGAAAGCAAGCCCTGGAAACCGTGCAAAGGTTGTTGCCGGTCCTTTGTC

AAGACCACGGCCTTACACCTGCACAAGTGGTCGCCATCGCCTCCAACGGTGGCGGTAAGCAGGCGCTGGAAACAGTACAGCGCCTGCTGCCTGTACT

GTGCCAGGATCATGGCTTGACACCCGAACAGGTGGTCGCCATTGCTAGCAACGGGGGAGGACGGCCAGCCTTGGAGTCCATCGTAGCCCAATTGTCC

AGGCCCGATCCCGCGTTGGCTGCGTTAACGAATGACCATCTGGTGGCGTTGGCATGTCTTGGTGGACGACCCGCGCTCGATGCAGTCAAAAAGGGTC

TGCCTCATGCTCCCGCATTGATCAAAAGAACCAACCGGCGGATTCCCGAGAGAACTTCCCATCGAGTCGCGGGATCCCAGCTGGTGAAGAGCGAGCT

GGAGGAGAAGAAGTCCGAGCTGCGGCACAAGCTGAAGTACGTGCCCCACGAGTACATCGAGCTGATCGAGATCGCCAGGAACAGCACCCAGGACCGC

ATCCTGGAGATGAAGGTGATGGAGTTCTTCATGAAGGTGTACGGCTACAGGGGAAAGCACCTGGGCGGAAGCAGAAAGCCTGACGGCGCCATCTATA

CAGTGGGCAGCCCCATCGATTACGGCGTGATCGTGGACACAAAGGCCTACAGCGGCGGCTACAATCTGCCTATCGGCCAGGCCGACGAGATGCAGAG

ATACGTGGAGGAGAACCAGACCCGGAATAAGCACATCAACCCCAACGAGTGGTGGAAGGTGTACCCTAGCAGCGTGACCGAGTTCAAGTTCCTGTTC

GTGAGCGGCCACTTCAAGGGCAACTACAAGGCCCAGCTGACCAGGCTGAACCACATCACCAACTGCAATGGCGCCGTGCTGAGCGTGGAGGAGCTGC

TGATCGGCGGCGAGATGATCAAAGCCGGCACCCTGACACTGGAGGAGGTGCGGCGCAAGTTCAACAACGGCGAGATCAACTTCAGATCT

> CCR5 R177 (+28)                                                                                   (SEQ ID NO: 259)
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIANNNGGKQA

LETVQRLLPVLCQDHGLTPEQVVAIASHDGGKQALETVQRLLPVLCQAHGLTPDQVVAIASNGGGKQALETVQRLLPVLCQAHGLTPAQVVAIASHD

GGKQALETVQRLLPVLCQDHGLTPDQVVAIASNGGGKQALETVQRLLPVLCQDHGLTPEQVVAIASNGGGKQALETVQRLLPVLCQAHGLTPDQVVA

IASHDGGKQALETVQRLLPVLCQAHGLTPAQVVAIASNIGGKQALETVQRLLPVLCQDHGLTPDQVVAIANNNGGKQALETVQRLLPVLCQDHGLTP

EQVVAIASHDGGKQALETVQRLLPVLCQAHGLTPDQVVAIASHDGGKQALETVQRLLPVLCQAHGLTPAQVVAIASNGGGKQALETVQRLLPVLCQD

HGLTPEQVVAIASNGGGRPALESIVAQLSRPDPALAALTNDHLVALACLGGSQLVKSELEEKKSELRHKLKYVPHEYIELIEIARNSTQDRILEMKV

MEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFK

GNYKAQLTRLNHITNCNGAVLSVEELLIGGEMIKAGTLTLEEVRRKFNNGEINFRS

> CCR5 R177 (+28)                                                                                   (SEQ ID NO: 260)
ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGAGTAACAGCGGTAGAGGC

AGTGCACGCCTGGCGCAATGCGCTCACCGGGGCCCCCTTGAACCTGACCCCAGACCAGGTAGTCGCAATCGCCAACAATAACGGGGGAAAGCAAGCC

CTGGAAACCGTGCAAAGGTTGTTGCCGGTCCTTTGTCAAGACCACGGCCTTACACCGGAGCAAGTCGTGGCCATTGCATCACATGACGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG

GAAACAAGCATTGGAGACTGTCCAACGGCTCCTTCCCGTGTTGTGTCAAGCCCACGGTTTGACGCCTGCACAAGTGGTCGCCATCGCCTCCCACGAC

GGCGGTAAGCAGGCGCTGGAAACAGTACAGCGCCTGCTGCCTGTACTGTGCCAGGATCATGGACTCACCCCAGACCAGGTAGTCGCAATCGCGTCGA

ATGGCGGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCCATGATGGAGGGAAACAAGCATTGGAGACTGTCCAACGGCTCCTTCCCGTGTTGTGTCAAGCCCACGGTTTGACGCCTGCACAAGTGG
```

```
TCGCCATCGCCTCCAATATTGGCGGTAAGCAGGCGCTGGAAACAGTACAGCGCCTGCTGCCTGTACTGTGCCAGGATCATGGGCTGACCCCAGACCA

GGTAGTCGCAATCGCCAACAATAACGGGGGAAAGCAAGCCCTGGAAACCGTGCAAAGGTTGTTGCCGGTCCTTTGTCAAGACCACGGCCTTACACCG

GAGCAAGTCGTGGCCATTGCATCACATGACGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCCATGATGGAGGGAAACAAGCATTGGAGACTGTCCAACGGCTCCTTCCCGTGTTGTGTCAAGCCCACGG

TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT

CATGGCCTGACACCCGAACAGGTGGTCGCCATTGCTAGCAACGGGGGAGGACGGCCAGCCTTGGAGTCCATCGTAGCCCAATTGTCCAGGCCCGATC

CCGCGTTGGCTGCGTTAACGAATGACCATCTGGTGGCGTTGGCATGTCTTGGTGGATCCCAGCTGGTGAAGAGCGAGCTGGAGGAGAAGAAGTCCGA

GCTGCGGCACAAGCTGAAGTACGTGCCCCACGAGTACATCGAGCTGATCGAGATCGCCAGGAACAGCACCCAGGACCGCATCCTGGAGATGAAGGTG

ATGGAGTTCTTCATGAAGGTGTACGGCTACAGGGGAAAGCACCTGGGCGGAAGCAGAAAGCCTGACGGCGCCATCTATACAGTGGGCAGCCCCATCG

ATTACGGCGTGATCGTGGACACAAAGGCCTACAGCGGCGGCTACAATCTGCCTATCGGCCAGGCCGACGAGATGCAGAGATACGTGGAGGAGAACCA

GACCCGGAATAAGCACATCAACCCCAACGAGTGGTGGAAGGTGTACCCTAGCAGCGTGACCGAGTTCAAGTTCCTGTTCGTGAGCGGCCACTTCAAG

GGCAACTACAAGGCCCAGCTGACCAGGCTGAACCACATCACCAACTGCAATGGCGCCGTGCTGAGCGTGGAGGAGCTGCTGATCGGCGGCGAGATGA

TCAAAGCCGGCACCCTGACACTGGAGGAGGTGCGGCGCAAGTTCAACAACGGCGAGATCAACTTCAGATCT
```

> CCR5 R177 (+63)  
(SEQ ID NO: 261)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIANNNGGKQA

LETVQRLLPVLCQDHGLTPEQVVAIASHDGGKQALETVQRLLPVLCQAHGLTPDQVVAIASNGGGKQALETVQRLLPVLCQAHGLTPAQVVAIASHD

GGKQALETVQRLLPVLCQDHGLTPDQVVAIASNGGGKQALETVQRLLPVLCQDHGLTPEQVVAIASNGGGKQALETVQRLLPVLCQAHGLTPDQVVA

IASHDGGKQALETVQRLLPVLCQAHGLTPAQVVAIASNIGGKQALETVQRLLPVLCQDHGLTPDQVVAIANNNGGKQALETVQRLLPVLCQDHGLTP

EQVVAIASHDGGKQALETVQRLLPVLCQAHGLTPDQVVAIASHDGGKQALETVQRLLPVLCQAHGLTPAQVVAIASNGGGKQALETVQRLLPVLCQD

HGLTPEQVVAIASNGGGRPALESIVAQLSRPDPALAALTNDHLVALACLGGRPALDAVKKGLPHAPALIKRTNRRIPERTSHRVAGSQLVKSELEEK

KSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVE

ENQTRNKHINPNEWWKVYPSSVTEFKFLFVSGHFKGNYKAQLTRLNHITNCNGAVLSVEELLIGGEMIKAGTLTLEEVRRKFNNGEINFRS
```

> CCR5 R177 (+63)  
(SEQ ID NO: 262)

```
ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGAGTAACAGCGGTAGAGGC

AGTGCACGCCTGGCGCAATGCGCTCACCGGGGCCCCCTTGAACCTGACCCCAGACCAGGTAGTCGCAATCGCCAACAATAACGGGGAAAGCAAGCC

CTGGAAACCGTGCAAAGGTTGTTGCCGGTCCTTTGTCAAGACCACGGCCTTACACCGGAGCAAGTCGTGGCCATTGCATCACATGACGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG

GAAACAAGCATTGGAGACTGTCCAACGGCTCCTTCCCGTGTTGTGTCAAGCCCACGTTTGACGCCTGCACAAGTGGTCGCCATCGCCTCCCACGAC

GGCGGTAAGCAGGCGCTGGAAACAGTACAGCGCCTGCTGCCTGTACTGTGCCAGGATCATGGACTCACCCCAGACCAGGTAGTCGCAATCGCGTCGA

ATGGCGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCCATGATGGAGGGAAACAAGCATTGGAGACTGTCCAACGGCTCCTTCCCGTGTTGTGTCAAGCCCACGTTTGACGCCTGCACAAGTGG

TCGCCATCGCCTCCAATATTGGCGGTAAGCAGGCGCTGGAAACAGTACAGCGCCTGCTGCCTGTACTGTGCCAGGATCATGGGCTGACCCCAGACCA

GGTAGTCGCAATCGCCAACAATAACGGGGAAAGCAAGCCCTGGAAACCGTGCAAAGGTTGTTGCCGGTCCTTTGTCAAGACCACGGCCTTACACCG

GAGCAAGTCGTGGCCATTGCATCACATGACGGTGGCAAACAGGCTCTTGAGACGGTTCAGAGACTTCTCCCAGTTCTCTGTCAAGCCCACGGGCTGA
```

-continued

```
CTCCCGATCAAGTTGTAGCGATTGCGAGCCATGATGGAGGGAAACAAGCATTGGAGACTGTCCAACGGCTCCTTCCCGTGTTGTGTCAAGCCCACGG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
CATGGCCTGACACCCGAACAGGTGGTCGCCATTGCTAGCAACGGGGAGGACGGCCAGCCTTGGAGTCCATCGTAGCCCAATTGTCCAGGCCCGATC
CCGCGTTGGCTGCGTTAACGAATGACCATCTGGTGGCGTTGGCATGTCTTGGTGGACGACCCGCGCTCGATGCAGTCAAAAAGGGTCTGCCTCATGC
TCCCGCATTGATCAAAAGAACCAACCGGCGGATTCCCGAGAGAACTTCCCATCGAGTCGCGGGATCCCAGCTGGTGAAGAGCGAGCTGGAGGAGAAG
AAGTCCGAGCTGCGGCACAAGCTGAAGTACGTGCCCCACGAGTACATCGAGCTGATCGAGATCGCCAGGAACAGCACCCAGGACCGCATCCTGGAGA
TGAAGGTGATGGAGTTCTTCATGAAGGTGTACGGCTACAGGGGAAAGCACCTGGGCGGAAGCAGAAAGCCTGACGGCGCCATCTATACAGTGGGCAG
CCCCATCGATTACGGCGTGATCGTGGACACAAAGGCCTACAGCGGCGGCTACAATCTGCCTATCGGCCAGGCCGACGAGATGCAGAGATACGTGGAG
GAGAACCAGACCCGGAATAAGCACATCAACCCCAACGAGTGGTGGAAGGTGTACCCTAGCAGCGTGACCGAGTTCAAGTTCCTGTTCGTGAGCGGCC
ACTTCAAGGGCAACTACAAGGCCCAGCTGACCAGGCTGAACCACATCACCAACTGCAATGGCGCCGTGCTGAGCGTGGAGGAGCTGCTGATCGGCGG
CGAGATGATCAAAGCCGGCACCCTGACACTGGAGGAGGTGCGGCGCAAGTTCAACAACGGCGAGATCAACTTCAGATCT
```

> CCR5 R178 (+28)                                                                                                            (SEQ ID NO: 263)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASHDGGKQA
LETVQRLLPVLCQDHGLTPEQVVAIASNIGGKQALETVQRLLPVLCQAHGLTPDQVVAIASNGGGKQALETVQRLLPVLCQAHGLTPAQVVAIANNN
GGKQALETVQRLLPVLCQDHGLTPDQVVAIASHDGGKQALETVQRLLPVLCQDHGLTPEQVVAIASNGGGKQALETVQRLLPVLCQAHGLTPDQVVA
IASHDGGKQALETVQRLLPVLCQAHGLTPAQVVAIASNGGGKQALETVQRLLPVLCQDHGLTPDQVVAIASNGGGKQALETVQRLLPVLCQDHGLTP
EQVVAIASHDGGKQALETVQRLLPVLCQAHGLTPDQVVAIASNIGGKQALETVQRLLPVLCQAHGLTPAQVVAIANNNGGKQALETVQRLLPVLCQD
HGLTPDQVVAIASHDGGKQALETVQRLLPVLCQDHGLTPAQVVAIASHDGGKQALETVQRLLPVLCQDHGLTPEQVVAIASNGGGRPALESIVAQLS
RPDPALAALTNDHLVALACLGGSQLVKSELEEKKSELRHKLKYVPHEYIELIEIARNSTQDRILEMKVMEFFMKVYGYRGKHLGGSRKPDGAIYTVG
SPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIG
GEMIKAGTLTLEEVRRKFNNGEINFRS
```

> CCR5 R178 (+28)                                                                                                            (SEQ ID NO: 264)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGAGTAACAGCGGTAGAGGC
AGTGCACGCCTGGCGCAATGCGCTCACCGGGGCCCCCTTGAACCTGACCCCAGACCAGGTAGTCGCAATCGCGTCGCATGACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCAAATATCGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGGTTTGACGCCTGCACAAGTGGTCGCCATCGCCAACAACAAC
GGCGGTAAGCAGGCGCTGGAAACAGTACAGCGCCTGCTGCCTGTACTGTGCCAGGATCATGGACTCACCCCAGACCAGGTAGTCGCAATCGCGTCGC
ATGACGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCCATGATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCAACGGTGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAATGCGGGGGAAAGCAAGCCCTGGAAACCGTGCAAAGGTTGTTGCCGGTCCTTTGTCAAGACCACGGCCTTACACCG
GAGCAAGTCGTGGCCATTGCATCACATGACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCAACATCGGAGGGAAACAAGCATTGGAGACTGTCCAACGGCTCCTTCCCGTGTTGTGTCAAGCCCACGG
TTTGACGCCTGCACAAGTGGTCGCCATCGCCAACAACAACGGCGGTAAGCAGGCGCTGGAAACAGTACAGCGCCTGCTGCCTGTACTGTGCCAGGAT
```

```
CATGGTTTGACCCCAGACCAGGTAGTCGCAATCGCGTCGCATGACGGGGGAAAGCAAGCCCTGGAAACCGTGCAAAGGTTGTTGCCGGTCCTTTGTC
AAGACCACGGCCTTACGCCTGCACAAGTGGTCGCCATCGCCTCCCACGACGGCGGTAAGCAGGCGCTGGAAACAGTACAGCGCCTGCTGCCTGTACT
GTGCCAGGATCATGGCCTGACACCCGAACAGGTGGTCGCCATTGCTAGCAACGGGGGAGGACGGCCAGCCTTGGAGTCCATCGTAGCCCAATTGTCC
AGGCCCGATCCCGCGTTGGCTGCGTTAACGAATGACCATCTGGTGGCGTTGGCATGTCTTGGTGGATCCCAGCTGGTGAAGAGCGAGCTGGAGGAGA
AGAAGTCCGAGCTGCGGCACAAGCTGAAGTACGTGCCCCACGAGTACATCGAGCTGATCGAGATCGCCAGGAACAGCACCCAGGACCGCATCCTGGA
GATGAAGGTGATGGAGTTCTTCATGAAGGTGTACGGCTACAGGGGAAAGCACCTGGGCGGAAGCAGAAAGCCTGACGGCGCCATCTATACAGTGGGC
AGCCCCATCGATTACGGCGTGATCGTGGACACAAAGGCCTACAGCGGCGGCTACAATCTGCCTATCGGCCAGGCCGACGAGATGCAGAGATACGTGG
AGGAGAACCAGACCCGGAATAAGCACATCAACCCCAACGAGTGGTGGAAGGTGTACCCTAGCAGCGTGACCGAGTTCAAGTTCCTGTTCGTGAGCGG
CCACTTCAAGGGCAACTACAAGGCCCAGCTGACCAGGCTGAACCACATCACCAACTGCAATGGCGCCGTGCTGAGCGTGGAGGAGCTGCTGATCGGC
GGCGAGATGATCAAAGCCGGCACCCTGACACTGGAGGAGGTGCGGCGCAAGTTCAACAACGGCGAGATCAACTTCAGATCT
```

> CCR5 R178 (+63) (SEQ ID NO: 265)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASHDGGKQA
LETVQRLLPVLCQDHGLTPEQVVAIASNIGGKQALETVQRLLPVLCQAHGLTPDQVVAIASNGGGKQALETVQRLLPVLCQAHGLTPAQVVAIANNN
GGKQALETVQRLLPVLCQDHGLTPDQVVAIASHDGGKQALETVQRLLPVLCQAHGLTPEQVVAIASNGGGKQALETVQRLLPVLCQAHGLTPDQVVA
IASHDGGKQALETVQRLLPVLCQAHGLTPAQVVAIASNGGGKQALETVQRLLPVLCQDHGLTPDQVVAIASNGGGKQALETVQRLLPVLCQDHGLTP
EQVVAIASHDGGKQALETVQRLLPVLCQAHGLTPDQVVAIASNIGGKQALETVQRLLPVLCQAHGLTPAQVVAIANNNGGKQALETVQRLLPVLCQD
HGLTPDQVVAIASHDGGKQALETVQRLLPVLCQDHGLTPAQVVAIASHDGGKQALETVQRLLPVLCQDHGLTPEQVVAIASNGGGRPALESIVAQLS
RPDPALAALTNDHLVALACLGGRPALDAVKKGLPHAPALIKRTNRRIPERTSHRVAGSQLVKSELEEKKSELRHKLKYVPHEYIELIEIARNSTQDR
ILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLF
VSGHFKGNYKAQLTRLNHITNCNGAVLSVEELLIGGEMIKAGTLTLEEVRRKFNNGEINFRS
```

> CCR5 R178 (+63) (SEQ ID NO: 266)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCGTCGCATGACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCAAATATCGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGTTTGACGCCTGCACAAGTGGTCGCCATCGCCAACAACAAC
GGCGGTAAGCAGGCGCTGGAAACAGTACAGCGCCTGCTGCCTGTACTGTGCCAGGATCATGGACTCACCCCAGACCAGGTAGTCGCAATCGCGTCGC
ATGACGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCCATGATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCAACGGTGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAATGGCGGGGGAAAGCAAGCCCTGGAAACCGTGCAAAGGTTGTTGCCGGTCCTTTGTCAAGACCACGGCCTTACACCG
GAGCAAGTCGTGGCCATTGCATCACATGACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCAACATCGGAGGGAAACAAGCATTGGAGACTGTCCAACGGCTCCTTCCCGTGTTGTGTCAAGCCCACG
TTTGACGCCTGCACAAGTGGTCGCCATCGCCAACAACAACGGCGGTAAGCAGGCGCTGGAAACAGTACAGCGCCTGCTGCCTGTACTGTGCCAGGAT
```

-continued

```
CATGGTTTGACCCCAGACCAGGTAGTCGCAATCGCGTCGCATGACGGGGAAAGCAAGCCCTGGAAACCGTGCAAAGGTTGTTGCCGGTCCTTTGTC
AAGACCACGGCCTTACGCCTGCACAAGTGGTCGCCATCGCCTCCCACGACGGCGGTAAGCAGGCGCTGGAAACAGTACAGCGCCTGCTGCCTGTACT
GTGCCAGGATCATGGCCTGACACCCGAACAGGTGGTCGCCATTGCTAGCAACGGGGAGGACGGCCAGCCTTGGAGTCCATCGTAGCCCAATTGTCC
AGGCCCGATCCCGCGTTGGCTGCGTTAACGAATGACCATCTGGTGGCGTTGGCATGTCTTGGTGGACGACCCGCGCTCGATGCAGTCAAAAAGGGTC
TGCCTCATGCTCCCGCATTGATCAAAAGAACCAACCGGCGGATTCCCGAGAGAACTTCCCATCGAGTCGCGGGATCCCAGCTGGTGAAGAGCGAGCT
GGAGGAGAAGAAGTCCGAGCTGCGGCACAAGCTGAAGTACGTGCCCCACGAGTACATCGAGCTGATCGAGATCGCCAGGAACAGCACCCAGGACCGC
ATCCTGGAGATGAAGGTGATGGAGTTCTTCATGAAGGTGTACGGCTACAGGGGAAAGCACCTGGGCGGAAGCAGAAAGCCTGACGGCGCCATCTATA
CAGTGGGCAGCCCCATCGATTACGGCGTGATCGTGGACACAAAGGCCTACAGCGGCGGCTACAATCTGCCTATCGGCCAGGCCGACGAGATGCAGAG
ATACGTGGAGGAGAACCAGACCCGGAATAAGCACATCAACCCCAACGAGTGGTGGAAGGTGTACCCTAGCAGCGTGACCGAGTTCAAGTTCCTGTTC
GTGAGCGGCCACTTCAAGGGCAACTACAAGGCCCAGCTGACCAGGCTGAACCACATCACCAACTGCAATGGCGCCGTGCTGAGCGTGGAGGAGCTGC
TGATCGGCGGCGAGATGATCAAAGCCGGCACCCTGACACTGGAGGAGGTGCGGCGCAAGTTCAACAACGGCGAGATCAACTTCAGATCT
```

> CCR5 R185 (+28) (SEQ ID NO: 267)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIANNNGGKQA
LETVQRLLPVLCQDHGLTPEQVVAIASNGGGKQALETVQRLLPVLCQAHGLTPDQVVAIASHDGGKQALETVQRLLPVLCQAHGLTPAQVVAIASNI
GGKQALETVQRLLPVLCQDHGLTPDQVVAIANNNGGKQALETVQRLLPVLCQDHGLTPEQVVAIASNGGGKQALETVQRLLPVLCQAHGLTPDQVVA
IASHDGGKQALETVQRLLPVLCQAHGLTPAQVVAIASNIGGKQALETVQRLLPVLCQDHGLTPDQVVAIASNGGGKQALETVQRLLPVLCQDHGLTP
DQVVAIANNNGGKQALETVQRLLPVLCQAHGLTPDQVVAIASHDGGKQALETVQRLLPVLCQAHGLTPAQVVAIASNGGGKQALETVQRLLPVLCQD
HGLTPDQVVAIASHDGGKQALETVQRLLPVLCQDHGLTPEQVVAIASNGGGRPALESIVAQLSRPDPALAALTNDHLVALACLGGSQLVKSELEEKK
SELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEE
NQTRNKHINPNEWWKVYPSSVTEFKFLFVSGHFKGNYKAQLTRLNHITNCNGAVLSVEELLIGGEMIKAGTLTLEEVARKFNNGEINFRS
```

> CCR5 R185 (+28) (SEQ ID NO: 268)

```
ATGGACTACAAAGACCATGACGGTGATTATAAAGATCATGACATCGATTACAAGGATGACGATGACAAGATGGCCCCCAAGAAGAAGAGGAAGGTGGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCCAACAATAACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCAAACGGAGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCCATGATGGAGG
GAAACAAGCATTGGAGACTGTCCAACGGCTCCTTCCCGTGTTGTGTCAAGCCCACGGTTTGACGCCTGCACAAGTGGTCGCCATCGCCTCCAATATT
GGCGGTAAGCAGGCGCTGGAAACAGTACAGCGCCTGCTGCCTGTACTGTGCCAGGATCATGGACTCACCCCAGACCAGGTAGTCGCAATCGCCAACA
ATAACGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCCATGATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCAATATTGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAATGGCGGGGAAAGCAAGCCCTGGAAACCGTGCAAAGGTTGTTGCCGGTCCTTTGTCAAGACCACGGCCTTACACCG
GATCAAGTCGTGGCCATTGCAAATAATAACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCCATGATGGAGGGAAACAAGCATTGGAGACTGTCCAACGGCTCCTTCCCGTGTTGTGTCAAGCCCACGG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
CATGGTTTGACCCCAGACCAGGTAGTCGCAATCGCGTCGCATGACGGGGAAAGCAAGCCCTGGAAACCGTGCAAAGGTTGTTGCCGGTACTGTGCC
```

-continued

AGGATCATGGCCTGACACCCGAACAGGTGGTCGCCATTGCTAGCAACGGGGAGGACGGCCAGCCTTGGAGTCCATCGTAGCCCAATTGTCCAGGCC
CGATCCCGCGTTGGCTGCGTTAACGAATGACCATCTGGTGGCGTTGGCATGTCTTGGTGATCCCAGCTGGTGAAGAGCGAGCTGGAGGAGAAGAAG
TCCGAGCTGCGGCACAAGCTGAAGTACGTGCCCCACGAGTACATCGAGCTGATCGAGATCGCCAGGAACAGCACCCAGGACCGCATCCTGGAGATGA
AGGTGATGGAGTTCTTCATGAAGGTGTACGGCTACAGGGGAAAGCACCTGGGCGGAAGCAGAAAGCCTGACGGCGCCATCTATACAGTGGGCAGCCC
CATCGATTACGGCGTGATCGTGGACACAAAGGCCTACAGCGGCGGCTACAATCTGCCTATCGGCCAGGCCGACGAGATGCAGAGATACGTGGAGGAG
AACCAGACCCGGAATAAGCACATCAACCCCAACGAGTGGTGGAAGGTGTACCCTAGCAGCGTGACCGAGTTCAAGTTCCTGTTCGTGAGCGGCCACT
TCAAGGGCAACTACAAGGCCCAGCTGACCAGGCTGAACCACATCACCAACTGCAATGGCGCCGTGCTGAGCGTGGAGGAGCTGCTGATCGGCGGCGA
GATGATCAAAGCCGGCACCCTGACACTGGAGGAGGTGCGGCGCAAGTTCAACAACGGCGAGATCAACTTCAGATCT

> CCR5 R185 (+63)                                                                              (SEQ ID NO: 269)

MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIANNNGGKQA
LETVQRLLPVLCQDHGLTPEQVVAIASNGGGKQALETVQRLLPVLCQAHGLTPDQVVAIASHDGGKQALETVQRLLPVLCQAHGLTPAQVVAIASNI
GGKQALETVQRLLPVLCQDHGLTPDQVVAIANNNGGKQALETVQRLLPVLCQAHGLTPEQVVAIASNGGGKQALETVQRLLPVLCQAHGLTPDQVVA
IASHDGGKQALETVQRLLPVLCQAHGLTPAQVVAIASNIGGKQALETVQRLLPVLCQDHGLTPDQVVAIASNGGGKQALETVQRLLPVLCQDHGLTP
DQVVAIANNNGGKQALETVQRLLPVLCQAHGLTPDQVVAIASHDGGKQALETVQRLLPVLCQAHGLTPAQVVAIASNGGGKQALETVQRLLPVLCQD
HGLTPDQVVAIASHDGGKQALETVQRLLPVLCQDHGLTPEQVVAIASNGGGRPALESIVAQLSRPDPALAALTNDHLVALACLGGRPALDAVKKGLP
HAPALIKRTNRRIPERTSHRVAGSQLVKSELEEKKSELRHKLKYVPHEYIELIEIARNSTQDRILEMKVMEFFMKVYGYRGKHLGGSRKPDGAIYTV
GSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLI
GGEMIKAGTLTLEEVRRKFNNGEINFRS

> CCR5 R185 (+63)                                                                              (SEQ ID NO: 270)

ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCCAACAATAACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCAAACGGAGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCCATGATGGAGG
GAAACAAGCATTGGAGACTGTCCAACGGCTCCTTCCCGTGTTGTGTCAAGCCCACGGTTTGACGCCTGCACAAGTGGTCGCCATCGCCTCCAATATT
GGCGGTAAGCAGGCGCTGGAAACAGTACAGCGCCTGCTGCCTGTACTGTGCCAGGATCATGGACTCACCCCAGACCAGGTAGTCGCAATCGCCAACA
ATAACGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCCATGATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCAATATTGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAATGGCGGGGAAAGCAAGCCCTGGAAACCGTGCAAAGGTTGTTGCCGGTCCTTTGTCAAGACCACGGCCTTACACCG
GATCAAGTCGTGGCCATTGCAAATAATAACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCCATGATGGAGGGAAACAAGCATTGGAGACTGTCCAACGGCTCCTTCCCGTGTTGTGTCAAGCCCACGG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
CATGGTTTGACCCCAGACCAGGTAGTCGCAATCGCGTCGCATGACGGGGAAAGCAAGCCCTGGAAACCGTGCAAAGGTTGTTGCCGGTACTGTGCC
AGGATCATGGCCTGACACCCGAACAGGTGGTCGCCATTGCTAGCAACGGGGAGGACGGCCAGCCTTGGAGTCCATCGTAGCCCAATTGTCCAGGCC

```
CGATCCCGCGTTGGCTGCGTTAACGAATGACCATCTGGTGGCGTTGGCATGTCTTGGTGGACGACCCGCGCTCGATGCAGTCAAAAAGGGTCTGCCT

CATGCTCCCGCATTGATCAAAAGAACCAACCGGCGGATTCCCGAGAGAACTTCCCATCGAGTCGCGGGATCCCAGCTGGTGAAGAGCGAGCTGGAGG

AGAAGAAGTCCGAGCTGCGGCACAAGCTGAAGTACGTGCCCCACGAGTACATCGAGCTGATCGAGATCGCCAGGAACAGCACCCAGGACCGCATCCT

GGAGATGAAGGTGATGGAGTTCTTCATGAAGGTGTACGGCTACAGGGGAAAGCACCTGGGCGGAAGCAGAAAGCCTGACGGCGCCATCTATACAGTG

GGCAGCCCCATCGATTACGGCGTGATCGTGGACACAAAGGCCTACAGCGGCGGCTACAATCTGCCTATCGGCCAGGCCGACGAGATGCAGAGATACG

TGGAGGAGAACCAGACCCGGAATAAGCACATCAACCCCAACGAGTGGTGGAAGGTGTACCCTAGCAGCGTGACCGAGTTCAAGTTCCTGTTCGTGAG

CGGCCACTTCAAGGGCAACTACAAGGCCCAGCTGACCAGGCTGAACCACATCACCAACTGCAATGGCGCCGTGCTGAGCGTGGAGGAGCTGCTGATC

GGCGGCGAGATGATCAAAGCCGGCACCCTGACACTGGAGGAGGTGCGGCGCAAGTTCAACAACGGCGAGATCAACTTCAGATCT
```

> CCR5 L532 (+28)                                                                                    (SEQ ID NO: 271)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIASHDGGKQA

LETVQRLLPVLCQDHGLTPEQVVAIASNGGGKQALETVQRLLPVLCQAHGLTPDQVVAIASNGGGKQALETVQRLLPVLCQAHGLTPAQVVAIASHD

GGKQALETVQRLLPVLCQDHGLTPDQVVAIASNIGGKQALETVQRLLPVLCQDHGLTPEQVVAIASNGGGKQALETVQRLLPVLCQAHGLTPDQVVA

IASNGGGKQALETVQRLLPVLCQAHGLTPAQVVAIASNIGGKQALETVQRLLPVLCQDHGLTPDQVVAIASHDGGKQALETVQRLLPVLCQDHGLTP

EQVVAIASNIGGKQALETVQRLLPVLCQAHGLTPDQVVAIASHDGGKQALETVQRLLPVLCQAHGLTPAQVVAIASHDGGKQALETVQRLLPVLCQD

HGLTPEQVVAIASNGGGRPALESIVAQLSRPDPALAALTNDHLVALACLGGSQLVKSELEEKKSELRHKLKYVPHEYIELIEIARNSTQDRILEMKV

MEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFK

GNYKAQLTRLNHITNCNGAVLSVEELLIGGEMIKAGTLTLEEVRRKFNNGEINFRS
```

> CCR5 L532 (+28)                                                                                    (SEQ ID NO: 272)

```
ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCGTCGCATGACGGGGGAAAGCAAGCC

CTGGAAACCGTGCAAAGGTTGTTGCCGGTCCTTTGTCAAGACCACGGCCTTACACCGGAGCAAGTCGTGGCCATTGCATCAAACGGAGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG

GAAACAAGCATTGGAGACTGTCCAACGGCTCCTTCCCGTGTTGTGTCAAGCCCACGGTTTGACGCCTGCACAAGTGGTCGCCATCGCCTCCCACGAC

GGCGGTAAGCAGGCGCTGGAAACAGTACAGCGCCTGCTGCCTGTACTGTGCCAGGATCATGGACTCACCCCAGACCAGGTAGTCGCAATCGCGTCGA

ACATTGGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCAATGGGGGAGGGAAACAAGCATTGGAGACTGTCCAACGGCTCCTTCCCGTGTTGTGTCAAGCCCACGGTTTGACGCCTGCACAAGTGG

TCGCCATCGCCTCCAATATTGGCGGTAAGCAGGCGCTGGAAACAGTACAGCGCCTGCTGCCTGTACTGTGCCAGGATCATGGGCTGACCCCAGACCA

GGTAGTCGCAATCGCGTCGCATGACGGGGGAAAGCAAGCCCTGGAAACCGTGCAAAGGTTGTTGCCGGTCCTTTGTCAAGACCACGGCCTTACACCG

GAGCAAGTCGTGGCCATTGCATCAAATATCGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCCATGATGGAGGGAAACAAGCATTGGAGACTGTCCAACGGCTCCTTCCCGTGTTGTGTCAAGCCCACGG

TTTGACGCCTGCACAAGTGGTCGCCATCGCCTCCCACGACGGCGGTAAGCAGGCGCTGGAAACAGTACAGCGCCTGCTGCCTGTACTGTGCCAGGAT

CATGGCCTGACACCCGAACAGGTGGTCGCCATTGCTAGCAACGGGGGAGGACGGCCAGCCTTGGAGTCCATCGTAGCCCAATTGTCCAGGCCCGATC

CCGCGTTGGCTGCGTTAACGAATGACCATCTGGTGGCGTTGGCATGTCTTGGTGGATCCCAGCTGGTGAAGAGCGAGCTGGAGGAGAAGAAGTCCGA

GCTGCGGCACAAGCTGAAGTACGTGCCCCACGAGTACATCGAGCTGATCGAGATCGCCAGGAACAGCACCCAGGACCGCATCCTGGAGATGAAGGTG

ATGGAGTTCTTCATGAAGGTGTACGGCTACAGGGGAAAGCACCTGGGCGGAAGCAGAAAGCCTGACGGCGCCATCTATACAGTGGGCAGCCCCATCG
```

```
ATTACGGCGTGATCGTGGACACAAAGGCCTACAGCGGCGGCTACAATCTGCCTATCGGCCAGGCCGACGAGATGCAGAGATACGTGGAGGAGAACCA

GACCCGGAATAAGCACATCAACCCCAACGAGTGGTGGAAGGTGTACCCTAGCAGCGTGACCGAGTTCAAGTTCCTGTTCGTGAGCGGCCACTTCAAG

GGCAACTACAAGGCCCAGCTGACCAGGCTGAACCACATCACCAACTGCAATGGCGCCGTGCTGAGCGTGGAGGAGCTGCTGATCGGCGGCGAGATGA

TCAAAGCCGGCACCCTGACACTGGAGGAGGTGCGGCGCAAGTTCAACAACGGCGAGATCAACTTCAGATCT
```

> CCR5 L532 (+63)                              (SEQ ID NO: 273)

```
MDYKDHDGDYKDHDIDYKDDDDKMAPKKKRKVGIHRGVPMVDLRTLGYSQQQQEKIKPKVASTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIASHDGGKQA

LETVQRLLPVLCQDHGLTPEQVVAIASNGGGKQALETVQRLLPVLCQAHGLTPDQVVAIASNGGGKQALETVQRLLPVLCQAHGLTPAQVVAIASHD

GGKQALETVQRLLPVLCQDHGLTPDQVVAIASNIGGKQALETVQRLLPVLCQDHGLTPEQVVAIASNGGGKQALETVQRLLPVLCQAHGLTPDQVVA

IASNGGGKQALETVQRLLPVLCQAHGLTPAQVVAIASNIGGKQALETVQRLLPVLCQDHGLTPDQVVAIASHDGGKQALETVQRLLPVLCQDHGLTP

EQVVAIASNIGGKQALETVQRLLPVLCQAHGLTPDQVVAIASHDGGKQALETVQRLLPVLCQAHGLTPAQVVAIASHDGGKQALETVQRLLPVLCQD

HGLTPEQVVAIASNGGGRPALESIVAQLSRPDPALAALTNDHLVALACLGGRPALDAVKKGLPHAPALIKRTNRRIPERTSHRVAGSQLVKSELEEK

KSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVE

ENQTRNKHINPNEWWKVYPSSVTEFKFLFVSGHFKGNYKAQLTRLNHITNCNGAVLSVEELLIGGEMIKAGTLTLEEVRRKFNNGEINFRS
```

> CCR5 L532 (+63)                              (SEQ ID NO: 274)

```
ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCGTCGCATGACGGGGGAAAGCAAGCC

CTGGAAACCGTGCAAAGGTTGTTGCCGGTCCTTTGTCAAGACCACGGCCTTACACCGGAGCAAGTCGTGGCCATTGCATCAAACGGAGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG

GAAACAAGCATTGGAGACTGTCCAACGGCTCCTTCCCGTGTTGTGTCAAGCCCACGGTTTGACGCCTGCACAAGTGGTCGCCATCGCCTCCCACGAC

GGCGGTAAGCAGGCGCTGGAAACAGTACAGCGCCTGCTGCCTGTACTGTGCCAGGATCATGGACTCACCCCAGACCAGGTAGTCGCAATCGCGTCGA

ACATTGGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCAATGGGGGAGGGAAACAAGCATTGGAGACTGTCCAACGGCTCCTTCCCGTGTTGTGTCAAGCCCACGGTTTGACGCCTGCACAAGTGG

TCGCCATCGCCTCCAATATTGGCGGTAAGCAGGCGCTGGAAACAGTACAGCGCCTGCTGCCTGTACTGTGCCAGGATCATGGGCTGACCCCAGACCA

GGTAGTCGCAATCGCGTCGCATGACGGGGGAAAGCAAGCCCTGGAAACCGTGCAAAGGTTGTTGCCGGTCCTTTGTCAAGACCACGGCCTTACACCG

GAGCAAGTCGTGGCCATTGCATCAAATATCGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCCATGATGGAGGGAAACAAGCATTGGAGACTGTCCAACGGCTCCTTCCCGTGTTGTGTCAAGCCCACGG

TTTGACGCCTGCACAAGTGGTCGCCATCGCCTCCCACGACGGCGGTAAGCAGGCGCTGGAAACAGTACAGCGCCTGCTGCCTGTACTGTGCCAGGAT

CATGGCCTGACACCCGAACAGGTGGTCGCCATTGCTAGCAACGGGGAGGACGGCCAGCCTTGGAGTCCATCGTAGCCCAATTGTCCAGGCCCGATC

CCGCGTTGGCTGCGTTAACGAATGACCATCTGGTGGCGTTGGCATGTCTTGGTGGACGACCCGCGCTCGATGCAGTCAAAAAGGGTCTGCCTCATGC

TCCCGCATTGATCAAAAGAACCAACCGGCGGATTCCCGAGAGAACTTCCCATCGAGTCGCGGGATCCCAGCTGGTGAAGAGCGAGCTGGAGGAGAAG

AAGTCCGAGCTGCGGCACAAGCTGAAGTACGTGCCCCACGAGTACATCGAGCTGATCGAGATCGCCAGGAACAGCACCCAGGACCGCATCCTGGAGA

TGAAGGTGATGGAGTTCTTCATGAAGGTGTACGGCTACAGGGGAAAGCACCTGGGCGGAAGCAGAAAGCCTGACGGCGCCATCTATACAGTGGGCAG

CCCCATCGATTACGGCGTGATCGTGGACACAAAGGCCTACAGCGGCGGCTACAATCTGCCTATCGGCCAGGCCGACGAGATGCAGAGATACGTGGAG

GAGAACCAGACCCGGAATAAGCACATCAACCCCAACGAGTGGTGGAAGGTGTACCCTAGCAGCGTGACCGAGTTCAAGTTCCTGTTCGTGAGCGGCC
```

```
ACTTCAAGGGCAACTACAAGGCCCAGCTGACCAGGCTGAACCACATCACCAACTGCAATGGCGCCGTGCTGAGCGTGGAGGAGCTGCTGATCGGCGG
CGAGATGATCAAAGCCGGCACCCTGACACTGGAGGAGGTGCGGCGCAAGTTCAACAACGGCGAGATCAACTTCAGATCT
```

> CCR5 L538 (+28) (SEQ ID NO: 275)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASNGGGKQA
LETVQRLLPVLCQDHGLTPEQVVAIASHDGGKQALETVQRLLPVLCQAHGLTPDQVVAIASNIGGKQALETVQRLLPVLCQAHGLTPAQVVAIASNG
GGKQALETVQRLLPVLCQDHGLTPDQVVAIASNGGGKQALETVQRLLPVLCQDHGLTPEQVVAIASNIGGKQALETVQRLLPVLCQAHGLTPDQVVA
IASHDGGKQALETVQRLLPVLCQAHGLTPAQVVAIASNIGGKQALETVQRLLPVLCQDHGLTPDQVVAIASHDGGKQALETVQRLLPVLCQDHGLTP
EQVVAIASHDGGKQALETVQRLLPVLCQAHGLTPDQVVAIASNGGGKQALETVQRLLPVLCQAHGLTPAQVVAIANNNGGKQALETVQRLLPVLCQD
HGLTPDQVVAIASHDGGKQALETVQRLLPVLCQDHGLTPEQVVAIASNIGGKQALETVQRLLPVLCQAHGLTPDQVVAIANNNGGKQALETVQRLLP
VLCQAHGLTPAQVVAIASHDGGKQALETVQRLLPVLCQDHGLTPEQVVAIASNGGGRPALESIVAQLSRPDPALAALTNDHLVALACLGGSQLVKSE
LEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQ
RYVEENQTRNKHINPNEWWKVYPSSVTEFKFLFVSGHFKGNYKAQLTRLNHITNCNGAVLSVEELLIGGEMIKAGTLTLEEVRRKFNNGEINFRS
```

> CCR5 L538 (+28) (SEQ ID NO: 276)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGCCCCCTTGAACCTGACCCCAGACCAGGTAGTCGCAATCGCGTCGAATGGCGGGGGAAAGCAAGCC
CTGGAAACCGTGCAAAGGTTGTTGCCGGTCCTTTGTCAAGACCACGGCCTTACACCGGAGCAAGTCGTGGCCATTGCATCACATGACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAACATCGGAGG
GAAACAAGCATTGGAGACTGTCCAACGGCTCCTTCCCGTGTTGTGTCAAGCCCACGGTTTGACGCCTGCACAAGTGGTCGCCATCGCCTCCAACGGT
GGCGGTAAGCAGGCGCTGGAAACAGTACAGCGCCTGCTGCCTGTACTGTGCCAGGATCATGGACTCACCCCAGACCAGGTAGTCGCAATCGCGTCGA
ATGGCGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAATATCGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCCATGATGAGGGAAACAAGCATTGGAGACTGTCCAACGGCTCCTTCCCGTGTTGTGTCAAGCCCACGGTTTGACGCCTGCACAAGTGG
TCGCCATCGCCTCCAATATTGGCGGTAAGCAGGCGCTGGAAACAGTACAGCGCCTGCTGCCTGTACTGTGCCAGGACCATGGGCTGACCCCAGACCA
GGTAGTCGCAATCGCGTCGCATGACGGGGAAAGCAAGCCCTGGAAACCGTGCAAAGGTTGTTGCCGGTCCTTTGTCAAGACCACGGCCTTACACCG
GAGCAAGTCGTGGCCATTGCATCACATGACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCAATGGGGGAGGGAAACAAGCATTGGAGACTGTCCAACGGCTCCTTCCCGTGTTGTGTCAAGCCCACGG
TTTGACGCCTGCACAAGTGGTCGCCATCGCCAACAACAACGGCGGTAAGCAGGCGCTGGAAACAGTACAGCGCCTGCTGCCTGTACTGTGCCAGGAT
CATGGTTTGACCCCAGACCAGGTAGTCGCAATCGCGTCGCATGACGGGGAAAGCAAGCCCTGGAAACCGTGCAAAGGTTGTTGCCGGTCCTTTGTC
AAGACCACGGCCTTACACCGGAGCAAGTCGTGGCCATTGCATCAAATATCGGTGGCAAACAGGCTCTTGAGACGGTTCAGAGACTTCTCCCAGTTCT
CTGTCAAGCCCACGGGCTGACTCCCGATCAAGTTGTAGCGATTGCGAATAACAATGGAGGGAAACAAGCATTGGAGACTGTCCAACGGCTCCTTCCC
GTGTTGTGTCAAGCCCACGGTTTGACGCCTGCACAAGTGGTCGCCATCGCCTCCACGACGGCGGTAAGCAGGCGCTGGAAACAGTACAGCGCCTGC
TGCCTGTACTGTGCCAGGATCATGGCTGACACCCGAACAGGTGGTCGCCATTGCTAGCAACGGGGAGGACGGCCAGCCTTGGAGTCCATCGTAGC
CCAATTGTCCAGGCCCGATCCCGCGTTGGCTGCGTTAACGAATGACCATCTGGTGGCGTTGGCATGTCTTGGTGGATCCCAGCTGGTGAAGAGCGAG
CTGGAGGAGAAGAAGTCCGAGCTGCGGCACAAGCTGAAGTACGTGCCCCACGAGTACATCGAGCTGATCGAGATCGCCAGGAACAGCACCCAGGACC
GCATCCTGGAGATGAAGGTGATGGAGTTCTTCATGAAGGTGTACGGCTACAGGGGAAAGCACCTGGGCGGAAGCAGAAAGCCTGACGGCGCCATCTA
TACAGTGGGCAGCCCCATCGATTACGGCGTGATCGTGGACACAAAGGCCTACAGCGGCGGCTACAATCTGCCTATCGGCCAGGCCGACGAGATGCAG
```

-continued

AGATACGTGGAGGAGAACCAGACCCGGAATAAGCACATCAACCCCAACGAGTGGTGGAAGGTGTACCCTAGCAGCGTGACCGAGTTCAAGTTCCTGT

TCGTGAGCGGCCACTTCAAGGGCAACTACAAGGCCCAGCTGACCAGGCTGAACCACATCACCAACTGCAATGGCGCCGTGCTGAGCGTGGAGGAGCT

GCTGATCGGCGGCGAGATGATCAAAGCCGGCACCCTGACACTGGAGGAGGTGCGGCGCAAGTTCAACAACGGCGAGATCAACTTCAGATCT

> CCR5 L538 (+63)

(SEQ ID NO: 277)

MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIASNGGGKQA

LETVQRLLPVLCQDHGLTPEQVVAIASHDGGKQALETVQRLLPVLCQAHGLTPDQVVAIASNIGGKQALETVQRLLPVLCQAHGLTPAQVVAIASNG

GGKQALETVQRLLPVLCQDHGLTPDQVVAIASNGGGKQALETVQRLLPVLCQDHGLTPEQVVAIASNIGGKQALETVQRLLPVLCQAHGLTPDQVVA

IASHDGGKQALETVQRLLPVLCQAHGLTPAQVVAIASNIGGKQALETVQRLLPVLCQDHGLTPDQVVAIASHDGGKQALETVQRLLPVLCQDHGLTP

EQVVAIASHDGGKQALETVQRLLPVLCQAHGLTPDQVVAIASNGGGKQALETVQRLLPVLCQAHGLTPAQVVAIANNNGGKQALETVQRLLPVLCQD

HGLTPDQVVAIASHDGGKQALETVQRLLPVLCQDHGLTPEQVVAIASNIGGKQALETVQRLLPVLCQAHGLTPDQVVAIANNNGGKQALETVQRLLP

VLCQAHGLTPAQVVAIASHDGGKQALETVQRLLPVLCQDHGLTPEQVVAIASNGGGRPALESIVAQLSRPDPALAALTNDHLVALACLGGRPALDAV

KKGLPHAPALIKRTNRRIPERTSHRVAGSQLVKSELEEKKSELRHKLKYVPHEYIELIEIARNSTQDRILEMKVMEFFMKVYGYRGKHLGGSRKPDG

AIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSV

EELLIGGEMIKAGTLTLEEVRRKFNNGEINFRS

> CCR5 L538 (+63)

(SEQ ID NO: 278)

ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCGTCGAATGGCGGGGGAAAGCAAGCC

CTGGAAACCGTGCAAAGGTTGTTGCCGGTCCTTTGTCAAGACCACGGCCTTACACCGGAGCAAGTCGTGGCCATTGCATCACATGACGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAACATCGGAGG

GAAACAAGCATTGGAGACTGTCCAACGGCTCCTTCCCGTGTTGTGTCAAGCCCACGGTTTGACGCCTGCACAAGTGGTCGCCATCGCCTCCAACGGT

GGCGGTAAGCAGGCGCTGGAAACAGTACAGCGCCTGCTGCCTGTACTGTGCCAGGATCATGGACTCACCCCAGACCAGGTAGTCGCAATCGCGTCGA

ATGGCGGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAATATCGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCCATGATGGAGGGAAACAAGCATTGGAGACTGTCCAACGGCTCCTTCCCGTGTTGTGTCAAGCCCACGGTTTGACGCCTGCACAAGTGG

TCGCCATCGCCTCCAATATTGGCGGTAAGCAGGCGCTGGAAACAGTACAGCGCCTGCTGCCTGTACTGTGCCAGGATCATGGGCTGACCCCAGACCA

GGTAGTCGCAATCGCGTCGCATGACGGGGGAAAGCAAGCCCTGGAAACCGTGCAAAGGTTGTTGCCGGTCCTTTGTCAAGACCACGGCCTTACACCG

GAGCAAGTCGTGGCCATTGCATCACATGACGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCAATGGGGGAGGGAAACAAGCATTGGAGACTGTCCAACGGCTCCTTCCCGTGTTGTGTCAAGCCCACGG

TTTGACGCCTGCACAAGTGGTCGCCATCGCCAACAACAACGGCGGTAAGCAGGCGCTGGAAACAGTACAGCGCCTGCTGCCTGTACTGTGCCAGGAT

CATGGTTTGACCCCAGACCAGGTAGTCGCAATCGCGTCGCATGACGGGGGAAAGCAAGCCCTGGAAACCGTGCAAAGGTTGTTGCCGGTCCTTTGTC

AAGACCACGGCCTTACACCGGAGCAAGTCGTGGCCATTGCATCAAATATCGGTGGCAAACAGGCTCTTGAGACGGTTCAGAGACTTCTCCCAGTTCT

CTGTCAAGCCCACGGGCTGACTCCCGATCAAGTTGTAGCGATTGCGAATAACAATGGAGGGAAACAAGCATTGGAGACTGTCCAACGGCTCCTTCCC

GTGTTGTGTCAAGCCCACGGTTTGACGCCTGCACAAGTGGTCGCCATCGCCTCCCACGACGGCGGTAAGCAGGCGCTGGAAACAGTACAGCGCCTGC

TGCCTGTACTGTGCCAGGATCATGGCCTGACACCCGAACAGGTGGTCGCCATTGCTAGCAACGGGGAGGACGGCCAGCCTTGGAGTCCATCGTAGC

CCAATTGTCCAGGCCCGATCCCGCGTTGGCTGCGTTAACGAATGACCATCTGGTGGCGTTGGCATGTCTTGGTGGACGACCCGCGCTCGATGCAGTC

-continued

```
AAAAAGGGTCTGCCTCATGCTCCCGCATTGATCAAAAGAACCAACCGGCGGATTCCCGAGAGAACTTCCCATCGAGTCGCGGGATCCCAGCTGGTGA
AGAGCGAGCTGGAGGAGAAGAAGTCCGAGCTGCGGCACAAGCTGAAGTACGTGCCCCACGAGTACATCGAGCTGATCGAGATCGCCAGGAACAGCAC
CCAGGACCGCATCCTGGAGATGAAGGTGATGGAGTTCTTCATGAAGGTGTACGGCTACAGGGGAAAGCACCTGGGCGGAAGCAGAAAGCCTGACGGC
GCCATCTATACAGTGGGCAGCCCCATCGATTACGGCGTGATCGTGGACACAAAGGCCTACAGCGGCGGCTACAATCTGCCTATCGGCCAGGCCGACG
AGATGCAGAGATACGTGGAGGAGAACCAGACCCGGAATAAGCACATCAACCCCAACGAGTGGTGGAAGGTGTACCCTAGCAGCGTGACCGAGTTCAA
GTTCCTGTTCGTGAGCGGCCACTTCAAGGGCAACTACAAGGCCCAGCTGACCAGGCTGAACCACATCACCAACTGCAATGGCGCCGTGCTGAGCGTG
GAGGAGCTGCTGATCGGCGGCGAGATGATCAAAGCCGGCACCCTGACACTGGAGGAGGTGCGGCGCAAGTTCAACAACGGCGAGATCAACTTCAGAT
CT
```

> CCR5 L540 (+28) (SEQ ID NO: 279)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASNIGGKQA
LETVQRLLPVLCQDHGLTPEQVVAIASHDGGKQALETVQRLLPVLCQAHGLTPDQVVAIASNIGGKQALETVQRLLPVLCQAHGLTPAQVVAIASHD
GGKQALETVQRLLPVLCQDHGLTPDQVVAIASHDGGKQALETVQRLLPVLCQDHGLTPEQVVAIASNGGGKQALETVQRLLPVLCQAHGLTPDQVVA
IANNNGGKQALETVQRLLPVLCQAHGLTPAQVVAIASHDGGKQALETVQRLLPVLCQDHGLTPDQVVAIASNIGGKQALETVQRLLPVLCQDHGLTP
DQVVAIANNNGGKQALETVQRLLPVLCQAHGLTPDQVVAIASHDGGKQALETVQRLLPVLCQAHGLTPAQVVAIASNGGGKQALETVQRLLPVLCQD
HGLTPDQVVAIASHDGGKQALETVQRLLPVLCQDHGLTPEQVVAIASNGGGRPALESIVAQLSRPDPALAALTNDHLVALACLGGSQLVKSELEEKK
SELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEE
NQTRNKHINPNEWWKVYPSSVTEFKFLFVSGHFKGNYKAQLTRLNHITNCNGAVLSVEELLIGGEMIKAGTLTLEEVRRKFNNGEINFRS
```

> CCR5 L540 (+28) (SEQ ID NO: 280)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCGTCGAACATTGGGGGAAAGCAAGCC
CTGGAAACCGTGCAAAGGTTGTTGCCGGTCCTTTGTCAAGACCACGGCCTTACACCGGAGCAAGTCGTGGCCATTGCATCACATGACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAACATCGGAGG
GAAACAAGCATTGGAGACTGTCCAACGGCTCCTTCCCGTGTTGTGTCAAGCCCACGGTTTGACGCCTGCACAAGTGGTCGCCATCGCCTCCCACGAC
GGCGGTAAGCAGGCGCTGGAAACAGTACAGCGCCTGCTGCCTGTACTGTGCCAGGATCATGGACTCACCCCAGACCAGGTAGTCGCAATCGCGTCGC
ATGACGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAATAACAATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCCACGACGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAACATTGGGGAAAGCAAGCCCTGGAAACCGTGCAAAGGTTGTTGCCGGTCCTTTGTCAAGACCACGGCCTTACACCGG
AGCAAGTCGTGGCCATTGCAAATAATAACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCCATGATGGAGGGAAACAAGCATTGGAGACTGTCCAACGGCTCCTTCCCGTGTTGTGTCAAGCCCACGG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
CATGGTTTGACCCCAGACCAGGTAGTCGCAATCGCGTCGCATGACGGGGAAAGCAAGCCCTGGAAACCGTGCAAAGGTTGTTGCCGGTACTGTGCC
AGGATCATGGCCTGACACCCGAACAGGTGGTCGCCATTGCTAGCAACGGGGAGGACGGCCAGCCTTGGAGTCCATCGTAGCCCAATTGTCCAGGCC
CGATCCCGCGTTGGCTGCGTTAACGAATGACCATCTGGTGGCGTTGGCATGTCTTGGTGGATCCCAGCTGGTGAAGAGCGAGCTGGAGGAGAAGAAG
TCCGAGCTGCGGCACAAGCTGAAGTACGTGCCCCACGAGTACATCGAGCTGATCGAGATCGCCAGGAACAGCACCCAGGACCGCATCCTGGAGATGA
```

AGGTGATGGAGTTCTTCATGAAGGTGTACGGCTACAGGGGAAAGCACCTGGGCGGAAGCAGAAAGCCTGACGGCGCCATCTATACAGTGGGCAGCCC

CATCGATTACGGCGTGATCGTGGACACAAAGGCCTACAGCGGCGGCTACAATCTGCCTATCGGCCAGGCCGACGAGATGCAGAGATACGTGGAGGAG

AACCAGACCCGGAATAAGCACATCAACCCCAACGAGTGGTGGAAGGTGTACCCTAGCAGCGTGACCGAGTTCAAGTTCCTGTTCGTGAGCGGCCACT

TCAAGGGCAACTACAAGGCCCAGCTGACCAGGCTGAACCACATCACCAACTGCAATGGCGCCGTGCTGAGCGTGGAGGAGCTGCTGATCGGCGGCGA

GATGATCAAAGCCGGCACCCTGACACTGGAGGAGGTGCGGCGCAAGTTCAACAACGGCGAGATCAACTTCAGATCT

> CCR5 L540 (+63)
(SEQ ID NO: 281)
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIASNIGGKQA

LETVQRLLPVLCQDHGLTPEQVVAIASHDGGKQALETVQRLLPVLCQAHGLTPDQVVAIASNIGGKQALETVQRLLPVLCQAHGLTPAQVVAIASHD

GGKQALETVQRLLPVLCQDHGLTPDQVVAIASHDGGKQALETVQRLLPVLCQDHGLTPEQVVAIASNGGGKQALETVQRLLPVLCQAHGLTPDQVVA

IANNNGGKQALETVQRLLPVLCQAHGLTPAQVVAIASHDGGKQALETVQRLLPVLCQDHGLTPDQVVAIASNIGGKQALETVQRLLPVLCQDHGLTP

DQVVAIANNNGGKQALETVQRLLPVLCQAHGLTPDQVVAIASHDGGKQALETVQRLLPVLCQAHGLTPAQVVAIASNGGGKQALETVQRLLPVLCQD

HGLTPDQVVAIASHDGGKQALETVQRLLPVLCQDHGLTPEQVVAIASNGGGRPALESIVAQLSRPDPALAALTNDHLVALACLGGRPALDAVKKGLP

HAPALIKRTNRRIPERTSHRVAGSQLVKSELEEKKSELRHKLKYVPHEYIELIEIARNSTQDRILEMKVMEFFMKVYGYRGKHLGGSRKPDGAIYTV

GSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLI

GGEMIKAGTLTLEEVRRKFNNGEINFRS

> CCR5 L540 (+63)
(SEQ ID NO: 282)
ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCGTCGAACATTGGGGGAAAGCAAGCC

CTGGAAACCGTGCAAAGGTTGTTGCCGGTCCTTTGTCAAGACCACGGCCTTACACCGGAGCAAGTCGTGGCCATTGCATCACATGACGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAACATCGGAGG

GAAACAAGCATTGGAGACTGTCCAACGGCTCCTTCCCGTGTTGTGTCAAGCCCACGGTTTGACGCCTGCACAAGTGGTCGCCATCGCCTCCCACGAC

GGCGGTAAGCAGGCGCTGGAAACAGTACAGCGCCTGCTGCCTGTACTGTGCCAGGATCATGGACTCACCCCAGACCAGGTAGTCGCAATCGCGTCGC

ATGACGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAATAACATGGAGGGAAACAAGCATTGGAGACTGTCCAACGGCTCCTTCCCGTGTTGTGTCAAGCCCACGGTTTGACGCCTGCACAAGTGG

TCGCCATCGCCTCCCACGACGGCGGTAAGCAGGCGCTGGAAACAGTACAGCGCCTGCTGCCTGTACTGTGCCAGGATCATGGGCTGACCCCAGACCA

GGTAGTCGCAATCGCGTCGAACATTGGGGAAAGCAAGCCCTGGAAACCGTGCAAAGGTTGTTGCCGGTCCTTTGTCAAGACCACGGCCTTACACCG

GATCAAGTCGTGGCCATTGCAAATAATAACGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCCATGATGGAGGGAAACAAGCATTGGAGACTGTCCAACGGCTCCTTCCCGTGTTGTGTCAAGCCCACGG

TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT

CATGGTTTGACCCCAGACCAGGTAGTCGCAATCGCGTCGCATGACGGGGAAAGCAAGCCCTGGAAACCGTGCAAAGGTTGTTGCCGGTACTGTGCC

AGGATCATGGCCTGACACCCGAACAGGTGGTCGCCATTGCTAGCAACGGGGAGGACGGCCAGCCTTGGAGTCCATCGTAGCCCAATTGTCCAGGCC

CGATCCCGCGTTGGCTGCGTTAACGAATGACCATCTGGTGGCGTTGGCATGTCTTGGTGGACGACCCGCGCTCGATGCAGTCAAAAAGGGTCTGCCT

CATGCTCCCGCATTGATCAAAAGAACCAACCGGCGGATTCCCGAGAGAACTTCCCATCGAGTCGCGGGATCCCAGCTGGTGAAGAGCGAGCTGGAGG

AGAAGAAGTCCGAGCTGCGGCACAAGCTGAAGTACGTGCCCCACGAGTACATCGAGCTGATCGAGATCGCCAGGAACAGCACCCAGGACCGCATCCT

-continued

GGAGATGAAGGTGATGGAGTTCTTCATGAAGGTGTACGGCTACAGGGGAAAGCACCTGGGCGGAAGCAGAAAGCCTGACGGCGCCATCTATACAGTG
GGCAGCCCCATCGATTACGGCGTGATCGTGGACACAAAGGCCTACAGCGGCGGCTACAATCTGCCTATCGGCCAGGCCGACGAGATGCAGAGATACG
TGGAGGAGAACCAGACCCGGAATAAGCACATCAACCCCAACGAGTGGTGGAAGGTGTACCCTAGCAGCGTGACCGAGTTCAAGTTCCTGTTCGTGAG
CGGCCACTTCAAGGGCAACTACAAGGCCCAGCTGACCAGGCTGAACCACATCACCAACTGCAATGGCGCCGTGCTGAGCGTGGAGGAGCTGCTGATC
GGCGGCGAGATGATCAAAGCCGGCACCCTGACACTGGAGGAGGTGCGGCGCAAGTTCAACAACGGCGAGATCAACTTCAGATCT

> CCR5 L543 (+28)

(SEQ ID NO: 283)

MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASNIGGKQA
LETVQRLLPVLCQDHGLTPEQVVAIASHDGGKQALETVQRLLPVLCQAHGLTPDQVVAIASNIGGKQALETVQRLLPVLCQAHGLTPAQVVAIASHD
GGKQALETVQRLLPVLCQDHGLTPDQVVAIASHDGGKQALETVQRLLPVLCQDHGLTPEQVVAIASNGGGKQALETVQRLLPVLCQAHGLTPDQVVA
IANNNGGKQALETVQRLLPVLCQAHGLTPAQVVAIASHDGGKQALETVQRLLPVLCQDHGLTPDQVVAIASNIGGKQALETVQRLLPVLCQDHGLTP
DQVVAIANNNGGKQALETVQRLLPVLCQAHGLTPDQVVAIASHDGGKQALETVQRLLPVLCQAHGLTPAQVVAIASNGGGKQALETVQRLLPVLCQD
HGLTPDQVVAIASHDGGKQALETVQRLLPVLCQDHGLTPEQVVAIASNGGGKQALETVQRLLPVLCQAHGLTPDQVVAIASHDGGKQALETVQRLLP
VLCQAHGLTPAQVVAIASNIGGKQALETVQRLLPVLCQDHGLTPEQVVAIASNGGGRPALESIVAQLSRPDPALAALTNDHLVALACLGGSQLVKSE
LEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQ
RYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

> CCR5 L543 (+28)

(SEQ ID NO: 284)

ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCGTCGAACATTGGGGGAAAGCAAGCC
CTGGAAACCGTGCAAAGGTTGTTGCCGGTCCTTTGTCAAGACCACGGCCTTACACCGGAGCAAGTCGTGGCCATTGCATCACATGACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAACATCGGAGG
GAAACAAGCATTGGAGACTGTCCAACGGCTCCTTCCCGTGTTGTGTCAAGCCCACGGTTTGACGCCTGCACAAGTGGTCGCCATCGCCTCCCACGAC
GGCGGTAAGCAGGCGCTGGAAACAGTACAGCGCCTGCTGCCTGTACTGTGCCAGGATCATGGACTCACCCCAGACCAGGTAGTCGCAATCGCGTCGC
ATGACGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAATAACAATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCCACGACGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAACATTGGGGGAAAGCAAGCCCTGGAAACCGTGCAAAGGTTGTTGCCGGTCCTTTGTCAAGACCACGGCCTTACACCG
GATCAAGTCGTGGCCATTGCAAATAATAACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCCATGATGGAGGGAAACAAGCATTGGAGACTGTCCAACGGCTCCTTCCCGTGTTGTGTCAAGCCCACGG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
CATGGTTTGACCCCAGACCAGGTAGTCGCAATCGCGTCGCATGACGGGGGAAAGCAAGCCCTGGAAACCGTGCAAAGGTTGTTGCCGGTCCTTTGTC
AAGACCACGGCCTTACACCGGAGCAAGTCGTGGCCATTGCATCAAACGGAGGTGGCAAACAGGCTCTTGAGACGGTTCAGAGACTTCTCCCAGTTCT
CTGTCAAGCCCACGGGCTGACTCCCGATCAAGTTGTAGCGATTGCGAGCCATGATGGAGGGAAACAAGCATTGGAGACTGTCCAACGGCTCCTTCCC
GTGTTGTGTCAAGCCCACGGTTTGACGCCTGCACAAGTGGTCGCCATCGCCTCCAATATTGGCGGTAAGCAGGCGCTGGAAACAGTACAGCGCCTGC
TGCCTGTACTGTGCCAGGATCATGGCCTGACACCCGAACAGGTGGTCGCCATTGCTAGCAACGGGGGAGGACGGCCAGCCTTGGAGTCCATCGTAGC
CCAATTGTCCAGGCCCGATCCCGCGTTGGCTGCGTTAACGAATGACCATCTGGTGGCGTTGGCATGTCTTGGTGGATCCCAGCTGGTGAAGAGCGAG

-continued

CTGGAGGAGAAGAAGTCCGAGCTGCGGCACAAGCTGAAGTACGTGCCCCACGAGTACATCGAGCTGATCGAGATCGCCAGGAACAGCACCCAGGACC

GCATCCTGGAGATGAAGGTGATGGAGTTCTTCATGAAGGTGTACGGCTACAGGGGAAAGCACCTGGGCGGAAGCAGAAAGCCTGACGGCGCCATCTA

TACAGTGGGCAGCCCCATCGATTACGGCGTGATCGTGGACACAAAGGCCTACAGCGGCGGCTACAATCTGCCTATCGGCCAGGCCGACGAGATGCAG

AGATACGTGGAGGAGAACCAGACCCGGAATAAGCACATCAACCCCAACGAGTGGTGGAAGGTGTACCCTAGCAGCGTGACCGAGTTCAAGTTCCTGT

TCGTGAGCGGCCACTTCAAGGGCAACTACAAGGCCCAGCTGACCAGGCTGAACCACATCACCAACTGCAATGGCGCCGTGCTGAGCGTGGAGGAGCT

GCTGATCGGCGGCGAGATGATCAAAGCCGGCACCCTGACACTGGAGGAGGTGCGGCGCAAGTTCAACAACGGCGAGATCAACTTCAGATCT

> CCR5 L543 (+63)
(SEQ ID NO: 285)
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIASNIGGKQA

LETVQRLLPVLCQDHGLTPEQVVAIASHDGGKQALETVQRLLPVLCQAHGLTPDQVVAIASNIGGKQALETVQRLLPVLCQAHGLTPAQVVAIASHD

GGKQALETVQRLLPVLCQDHGLTPDQVVAIASHDGGKQALETVQRLLPVLCQDHGLTPEQVVAIASNGGGKQALETVQRLLPVLCQAHGLTPDQVVA

IANNNGGKQALETVQRLLPVLCQAHGLTPAQVVAIASHDGGKQALETVQRLLPVLCQDHGLTPDQVVAIASNIGGKQALETVQRLLPVLCQDHGLTP

DQVVAIANNNGGKQALETVQRLLPVLCQAHGLTPDQVVAIASHDGGKQALETVQRLLPVLCQAHGLTPAQVVAIASNGGGKQALETVQRLLPVLCQD

HGLTPDQVVAIASHDGGKQALETVQRLLPVLCQDHGLTPEQVVAIASNGGGKQALETVQRLLPVLCQAHGLTPDQVVAIASHDGGKQALETVQRLLP

VLCQAHGLTPAQVVAIASNIGGKQALETVQRLLPVLCQDHGLTPEQVVAIASNGGGRPALESIVAQLSRPDPALAALTNDHLVALACLGGRPALDAV

KKGLPHAPALIKRTNRRIPERTSHRVAGSQLVKSELEEKKSELRHKLKYVPHEYIELIEIARNSTQDRILEMKVMEFFMKVYGYRGKHLGGSRKPDG

AIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSV

EELLIGGEMIKAGTLTLEEVRRKFNNGEINFRS

> CCR5 L543 (+63)
(SEQ ID NO: 286)
ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCGTCGAACATTGGGGGAAAGCAAGCC

CTGGAAACCGTGCAAAGGTTGTTGCCGGTCCTTTGTCAAGACCACGGCCTTACACCGGAGCAAGTCGTGGCCATTGCATCACATGACGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAACATCGGAGG

GAAACAAGCATTGGAGACTGTCCAACGGCTCCTTCCCGTGTTGTGTCAAGCCCACGGTTTGACGCCTGCACAAGTGGTCGCCATCGCCTCCCACGAC

GGCGGTAAGCAGGCGCTGGAAACAGTACAGCGCCTGCTGCCTGTACTGTGCCAGGATCATGGACTCACCCCAGACCAGGTAGTCGCAATCGCGTCGC

ATGACGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAATAACATGGAGGGAAACAAGCATTGGAGACTGTCCAACGGCTCCTTCCCGTGTTGTGTCAAGCCCACGGTTTGACGCCTGCACAAGTGG

TCGCCATCGCCTCCCACGACGGCGGTAAGCAGGCGCTGGAAACAGTACAGCGCCTGCTGCCTGTACTGTGCCAGGATCATGGGCTGACCCCAGACCA

GGTAGTCGCAATCGCGTCGAACATTGGGGGAAAGCAAGCCCTGGAAACCGTGCAAAGGTTGTTGCCGGTCCTTTGTCAAGACCACGGCCTTACACCG

GATCAAGTCGTGGCCATTGCAAATAATAACGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCCATGATGGAGGGAAACAAGCATTGGAGACTGTCCAACGGCTCCTTCCCGTGTTGTGTCAAGCCCACGG

TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT

CATGGTTTGACCCCAGACCAGGTAGTCGCAATCGCGTCGCATGACGGGGAAAGCAAGCCCTGGAAACCGTGCAAAGGTTGTTGCCGGTCCTTTGTC

AAGACCACGGCCTTACACCGGAGCAAGTCGTGGCCATTGCATCAAACGGAGGTGGCAAACAGGCTCTTGAGACGGTTCAGAGACTTCTCCCAGTTCT

CTGTCAAGCCCACGGGCTGACTCCCGATCAAGTTGTAGCGATTGCGAGCCATGATGGAGGGAAACAAGCATTGGAGACTGTCCAACGGCTCCTTCCC

-continued

```
GTGTTGTGTCAAGCCCACGGTTTGACGCCTGCACAAGTGGTCGCCATCGCCTCCAATATTGGCGGTAAGCAGGCGCTGGAAACAGTACAGCGCCTGC
TGCCTGTACTGTGCCAGGATCATGGCCTGACACCCGAACAGGTGGTCGCCATTGCTAGCAACGGGGGAGGACGGCCAGCCTTGGAGTCCATCGTAGC
CCAATTGTCCAGGCCCGATCCCGCGTTGGCTGCGTTAACGAATGACCATCTGGTGGCGTTGGCATGTCTTGGTGGACGACCCGCGCTCGATGCAGTC
AAAAAGGGTCTGCCTCATGCTCCCGCATTGATCAAAAGAACCAACCGGCGGATTCCCGAGAGAACTTCCCATCGAGTCGCGGGATCCCAGCTGGTGA
AGAGCGAGCTGGAGGAGAAGAAGTCCGAGCTGCGCACAAGCTGAAGTACGTGCCCCACGAGTACATCGAGCTGATCGAGATCGCCAGGAACAGCAC
CCAGGACCGCATCCTGGAGATGAAGGTGATGGAGTTCTTCATGAAGGTGTACGGCTACAGGGGAAAGCACCTGGGCGGAAGCAGAAAGCCTGACGGC
GCCATCTATACAGTGGGCAGCCCCATCGATTACGGCGTGATCGTGGACACAAAGGCCTACAGCGGCGGCTACAATCTGCCTATCGGCCAGGCCGACG
AGATGCAGAGATACGTGGAGGAGAACCAGACCCGGAATAAGCACATCAACCCCAACGAGTGGTGGAAGGTGTACCCTAGCAGCGTGACCGAGTTCAA
GTTCCTGTTCGTGAGCGGCCACTTCAAGGGCAACTACAAGGCCCAGCTGACCAGGCTGAACCACATCACCAACTGCAATGGCGCCGTGCTGAGCGTG
GAGGAGCTGCTGATCGGCGGCGAGATGATCAAAGCCGGCACCCTGACACTGGAGGAGGTGCGGCGCAAGTTCAACAACGGCGAGATCAACTTCAGAT
CT
```

> CCR5 R549 (+28)
(SEQ ID NO: 287)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIANNNGGKQA
LETVQRLLPVLCQDHGLTPEQVVAIASNIGGKQALETVQRLLPVLCQAHGLTPDQVVAIASNGGGKQALETVQRLLPVLCQAHGLTPAQVVAIASNI
GGKQALETVQRLLPVLCQDHGLTPDQVVAIASHDGGKQALETVQRLLPVLCQDHGLTPEQVVAIASNGGGKQALETVQRLLPVLCQAHGLTPDQVVA
IANNNGGKQALETVQRLLPVLCQAHGLTPAQVVAIASNIGGKQALETVQRLLPVLCQDHGLTPDQVVAIASHDGGKQALETVQRLLPVLCQDHGLTP
EQVVAIASNGGGKQALETVQRLLPVLCQAHGLTPDQVVAIANNNGGKQALETVQRLLPVLCQAHGLTPAQVVAIASNGGGKQALETVQRLLPVLCQD
HGLTPDQVVAIASNIGGKQALETVQRLLPVLCQDHGLTPEQVVAIASNGGGRPALESIVAQLSRPDPALAALTNDHLVALACLGGSQLVKSELEEKK
SELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEE
NQTRNKHINPNEWWKVYPSSVTEFKFLFVSGHFKGNYKAQLTRLNHITNCNGAVLSVEELLIGGEMIKAGTLTLEEVRRKFNNGEINFRS
```

> CCR5 R549 (+28)
(SEQ ID NO: 288)

```
ATGGACTACAAAGACCATGACGGTGATTATAAAGATCATGACATCGATTACAAGGATGACGATGACAAGATGGCCCCCAAGAAGAAGAGGAAGGTGGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCCAACAATAACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCAAATATCGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGGTTTGACGCCTGCACAAGTGGTCGCCATCGCCTCCAATATT
GGCGGTAAGCAGGCGCTGGAAACAGTACAGCGCCTGCTGCCTGTACTGTGCCAGGATCATGGACTCACCCCAGACCAGGTAGTCGCAATCGCGTCGC
ATGACGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG
ATTGCGAATAACAATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCAATATTGGCGGTAAGCAGGCGCTGGAAACAGTACAGCGCCTGCTGCCTGTACTGTGCCAGGATCATGGGCTGACCCCAGACCA
GGTAGTCGCAATCGCGTCGCATGACGGGGAAAGCAAGCCCTGGAAACCGTGCAAAGGTTGTTGCCGGTCCTTTGTCAAGACCACGGCCTTACACCG
GAGCAAGTCGTGGCCATTGCATCAAACGGAGGTGGCAAACAGGCTCTTGAGACGGTTCAGAGACTTCTCCCAGTTCTCTGTCAAGCCCACGGGCTGA
CTCCCGATCAAGTTGTAGCGATTGCGAATAACAATGGAGGGAAACAAGCATTGGAGACTGTCCAACGGCTCCTTCCCGTGTTGTGTCAAGCCCACGG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
CATGGTTTGACCCCAGACCAGGTAGTCGCAATCGCGTCGAACATTGGGGGAAAGCAAGCCCTGGAAACCGTGCAAAGGTTGTTGCCGGTACTGTGCC
```

-continued

AGGATCATGGCCTGACACCCGAACAGGTGGTCGCCATTGCTAGCAACGGGGAGGACGGCCAGCCTTGGAGTCCATCGTAGCCCAATTGTCCAGGCC

CGATCCCGCGTTGGCTGCGTTAACGAATGACCATCTGGTGGCGTTGGCATGTCTTGGTGATCCCAGCTGGTGAAGAGCGAGCTGGAGGAGAAGAAG

TCCGAGCTGCGGCACAAGCTGAAGTACGTGCCCCACGAGTACATCGAGCTGATCGAGATCGCCAGGAACAGCACCCAGGACCGCATCCTGGAGTGA

AGGTGATGGAGTTCTTCATGAAGGTGTACGGCTACAGGGGAAAGCACCTGGGCGGAAGCAGAAAGCCTGACGGCGCCATCTATACAGTGGGCAGCCC

CATCGATTACGGCGTGATCGTGGACACAAAGGCCTACAGCGGCGGCTACAATCTGCCTATCGGCCAGGCCGACGAGATGCAGAGATACGTGGAGGAG

AACCAGACCCGGAATAAGCACATCAACCCCAACGAGTGGTGGAAGGTGTACCCTAGCAGCGTGACCGAGTTCAAGTTCCTGTTCGTGAGCGGCCACT

TCAAGGGCAACTACAAGGCCCAGCTGACCAGGCTGAACCACATCACCAACTGCAATGGCGCCGTGCTGAGCGTGGAGGAGCTGCTGATCGGCGGCGA

GATGATCAAGCCGGCACCCTGACACTGGAGGAGGTGCGGCGCAAGTTCAACAACGGCGAGATCAACTTCAGATCT

> CCR5 R549 (+63)                                                                          (SEQ ID NO: 289)

MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIANNNGGKQA

LETVQRLLPVLCQDHGLTPEQVVAIASNIGGKQALETVQRLLPVLCQAHGLTPDQVVAIASNGGGKQALETVQRLLPVLCQAHGLTPAQVVAIASNI

GGKQALETVQRLLPVLCQDHGLTPDQVVAIASHDGGKQALETVQRLLPVLCQDHGLTPEQVVAIASNGGGKQALETVQRLLPVLCQAHGLTPDQVVA

IANNNGGKQALETVQRLLPVLCQAHGLTPAQVVAIASNIGGKQALETVQRLLPVLCQDHGLTPDQVVAIASHDGGKQALETVQRLLPVLCQDHGLTP

EQVVAIASNGGGKQALETVQRLLPVLCQAHGLTPDQVVAIANNNGGKQALETVQRLLPVLCQAHGLTPAQVVAIASNGGGKQALETVQRLLPVLCQD

HGLTPDQVVAIASNIGGKQALETVQRLLPVLCQDHGLTPEQVVAIASNGGGRPALESIVAQLSRPDPALAALTNDHLVALACLGGRPALDAVKKGLP

HAPALIKRTNRRIPERTSHRVAGSQLVKSELEEKKSELRHKLKYVPHEYIELIEIARNSTQDRILEMKVMEFFMKVYGYRGKHLGGSRKPDGAIYTV

GSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLI

GGEMIKAGTLTLEEVRRKFNNGEINFRS

> CCR5 R549 (+63)                                                                          (SEQ ID NO: 290)

ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCCAACAATAACGGGGGAAAGCAAGCC

CTGGAAACCGTGCAAAGGTTGTTGCCGGTCCTTTGTCAAGACCACGGCCTTACACCGGAGCAAGTCGTGGCCATTGCATCAAATATCGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG

GAAACAAGCATTGGAGACTGTCCAACGGCTCCTTCCCGTGTTGTGTCAAGCCCACGTTTGACGCCTGCACAAGTGGTCGCCATCGCCTCCAATATT

GGCGGTAAGCAGGCGCTGGAAACAGTACAGCGCCTGCTGCCTGTACTGTGCCAGGATCATGGACTCACCCCAGACCAGGTAGTCGCAATCGCGTCGC

ATGACGGGGAAAGCAAGCCCTGGAAACCGTGCAAAGGTTGTTGCCGGTCCTTTGTCAAGACCACGGCCTTACACCGGAGCAAGTCGTGGCCATTGC

ATCAAACGGAGGTGGCAAACAGGCTCTTGAGACGGTTCAGAGACTTCTCCCAGTTCTCTGTCAAGCCCACGGGCTGACTCCCGATCAAGTTGTAGCG

ATTGCGAATAACAATGGAGGGAAACAAGCATTGGAGACTGTCCAACGGCTCCTTCCCGTGTTGTGTCAAGCCCACGTTTGACGCCTGCACAAGTGG

TCGCCATCGCCTCCAATATTGGCGGTAAGCAGGCGCTGGAAACAGTACAGCGCCTGCTGCCTGTACTGTGCCAGGATCATGGGCTGACCCCAGACCA

GGTAGTCGCAATCGCGTCGCATGACGGGGAAAGCAAGCCCTGGAAACCGTGCAAAGGTTGTTGCCGGTCCTTTGTCAAGACCACGGCCTTACACCG

GAGCAAGTCGTGGCCATTGCATCAAACGGAGGTGGCAAACAGGCTCTTGAGACGGTTCAGAGACTTCTCCCAGTTCTCTGTCAAGCCCACGGGCTGA

CTCCCGATCAAGTTGTAGCGATTGCGAATAACAATGGAGGGAAACAAGCATTGGAGACTGTCCAACGGCTCCTTCCCGTGTTGTGTCAAGCCCACGG

TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT

CATGGTTTGACCCCAGACCAGGTAGTCGCAATCGCGTCGAACATTGGGGAAAGCAAGCCCTGGAAACCGTGCAAAGGTTGTTGCCGGTACTGTGCC

AGGATCATGGCCTGACACCCGAACAGGTGGTCGCCATTGCTAGCAACGGGGAGGACGGCCAGCCTTGGAGTCCATCGTAGCCCAATTGTCCAGGCC

-continued

CGATCCCGCGTTGGCTGCGTTAACGAATGACCATCTGGTGGCGTTGGCATGTCTTGGTGGACGACCCGCGCTCGATGCAGTCAAAAAGGGTCTGCCT

CATGCTCCCGCATTGATCAAAAGAACCAACCGGCGGATTCCCGAGAGAACTTCCCATCGAGTCGCGGGATCCCAGCTGGTGAAGAGCGAGCTGGAGG

AGAAGAAGTCCGAGCTGCGGCACAAGCTGAAGTACGTGCCCCACGAGTACATCGAGCTGATCGAGATCGCCAGGAACAGCACCCAGGACCGCATCCT

GGAGATGAAGGTGATGGAGTTCTTCATGAAGGTGTACGGCTACAGGGGAAAGCACCTGGGCGGAAGCAGAAAGCCTGACGGCGCCATCTATACAGTG

GGCAGCCCCATCGATTACGGCGTGATCGTGGACACAAAGGCCTACAGCGGCGGCTACAATCTGCCTATCGGCCAGGCCGACGAGATGCAGAGATACG

TGGAGGAGAACCAGACCCGGAATAAGCACATCAACCCCAACGAGTGGTGGAAGGTGTACCCTAGCAGCGTGACCGAGTTCAAGTTCCTGTTCGTGAG

CGGCCACTTCAAGGGCAACTACAAGGCCCAGCTGACCAGGCTGAACCACATCACCAACTGCAATGGCGCCGTGCTGAGCGTGGAGGAGCTGCTGATC

GGCGGCGAGATGATCAAAGCCGGCACCCTGACACTGGAGGAGGTGCGGCGCAAGTTCAACAACGGCGAGATCAACTTCAGATCT

> CCR5 R551 (+28)

(SEQ ID NO: 291)

MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIASNGGGKQA

LETVQRLLPVLCQDHGLTPDQVVAIANNNGGKQALETVQRLLPVLCQAHGLTPDQVVAIASNIGGKQALETVQRLLPVLCQAHGLTPAQVVAIASNG

GGKQALETVQRLLPVLCQDHGLTPDQVVAIASNIGGKQALETVQRLLPVLCQDHGLTPEQVVAIASHDGGKQALETVQRLLPVLCQAHGLTPDQVVA

IASNGGGKQALETVQRLLPVLCQAHGLTPAQVVAIANNNGGKQALETVQRLLPVLCQDHGLTPDQVVAIASNIGGKQALETVQRLLPVLCQDHGLTP

EQVVAIASHDGGKQALETVQRLLPVLCQAHGLTPDQVVAIASNGGGKQTLETVQRLLPVLCQAHGLTPAQVVAIANNNGGKQALETVQRLLPVLCQD

HGLTPEQVVAIASNGGGRPALESIVAQLSRPDPALAALTNDHLVALACLGGSQLVKSELEEKKSELRHKLKYVPHEYIELIEIARNSTQDRILEMKV

MEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFK

GNYKAQLTRLNHITNCNGAVLSVEELLIGGEMIKAGTLTLEEVRRKFNNGEINFRS

> CCR5 R551 (+28)

(SEQ ID NO: 292)

ATGGACTACAAAGACCATGACGGTGATTATAAAGATCATGACATCGATTACAAGGATGACGATGACAAGATGGCCCCCAAGAAGAAGAGGAAGGTGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCGTCGAATGGCGGGGGAAAGCAAGCC

CTGGAAACCGTGCAAAGGTTGTTGCCGGTCCTTTGTCAAGACCACGGCCTTACACCGGATCAAGTCGTGGCCATTGCAAATAATAACGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAACATCGGAGG

GAAACAAGCATTGGAGACTGTCCAACGGCTCCTTCCCGTGTTGTGTCAAGCCCACGGTTTGACGCCTGCACAAGTGGTCGCCATCGCCTCCAACGGT

GGCGGTAAGCAGGCGCTGGAAACAGTACAGCGCCTGCTGCCTGTACTGTGCCAGGATCATGGACTCACCCCAGACCAGGTAGTCGCAATCGCGTCGA

ACATTGGGGGAAAGCAAGCCCTGGAAACCGTGCAAAGGTTGTTGCCGGTCCTTTGTCAAGACCACGGCCTTACACCGGAGCAAGTCGTGGCCATTGC

ATCACATGACGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCAATGGGGGAGGGAAACAAGCATTGGAGACTGTCCAACGGCTCCTTCCCGTGTTGTGTCAAGCCCACGGTTTGACGCCTGCACAAGTGG

TCGCCATCGCCAACAACAACGGCGGTAAGCAGGCGCTGGAAACAGTACAGCGCCTGCTGCCTGTACTGTGCCAGGATCATGGGCTGACCCCAGACCA

GGTAGTCGCAATCGCGTCGAACATTGGGGGAAAGCAAGCCCTGGAAACCGTGCAAAGGTTGTTGCCGGTCCTTTGTCAAGACCACGGCCTTACACCG

GAGCAAGTCGTGGCCATTGCATCACATGACGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCAATGGGGGAGGGAAACAAACATTGGAGACTGTCCAACGGCTCCTTCCCGTGTTGTGTCAAGCCCACGG

TTTGACGCCTGCACAAGTGGTCGCCATCGCCAACAACAACGGCGGTAAGCAGGCGCTGGAAACAGTACAGCGCCTGCTGCCTGTACTGTGCCAGGAT

CATGGCCTGACACCCGAACAGGTGGTCGCCATTGCTAGCAACGGGGGAGGACGGCCAGCCTTGGAGTCCATCGTAGCCCAATTGTCCAGGCCCGATC

CCGCGTTGGCTGCGTTAACGAATGACCATCTGGTGGCGTTGGCATGTCTTGGTGGATCCCAGCTGGTGAAGAGCGAGCTGGAGGAGAAGAAGTCCGA

GCTGCGGCACAAGCTGAAGTACGTGCCCCACGAGTACATCGAGCTGATCGAGATCGCCAGGAACAGCACCCAGGACCGCATCCTGGAGATGAAGGTG

ATGGAGTTCTTCATGAAGGTGTACGGCTACAGGGGAAAGCACCTGGGCGGAAGCAGAAAGCCTGACGGCGCCATCTATACAGTGGGCAGCCCCATCG

```
ATTACGGCGTGATCGTGGACACAAAGGCCTACAGCGGCGGCTACAATCTGCCTATCGGCCAGGCCGACGAGATGCAGAGATACGTGGAGGAGAACCA
GACCCGGAATAAGCACATCAACCCCAACGAGTGGTGGAAGGTGTACCCTAGCAGCGTGACCGAGTTCAAGTTCCTGTTCGTGAGCGGCCACTTCAAG
GGCAACTACAAGGCCCAGCTGACCAGGCTGAACCACATCACCAACTGCAATGGCGCCGTGCTGAGCGTGGAGGAGCTGCTGATCGGCGGCGAGATGA
TCAAAGCCGGCACCCTGACACTGGAGGAGGTGCGGCGCAAGTTCAACAACGGCGAGATCAACTTCAGATCT
```

> CCR5 R551 (+63)

(SEQ ID NO: 293)
```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASNGGGKQA
LETVQRLLPVLCQDHGLTPDQVVAIANNNGGKQALETVQRLLPVLCQAHGLTPDQVVAIASNIGGKQALETVQRLLPVLCQAHGLTPAQVVAIASNG
GGKQALETVQRLLPVLCQDHGLTPDQVVAIASNIGGKQALETVQRLLPVLCQDHGLTPEQVVAIASHDGGKQALETVQRLLPVLCQAHGLTPDQVVA
IASNGGGKQALETVQRLLPVLCQAHGLTPAQVVAIANNNGGKQALETVQRLLPVLCQDHGLTPDQVVAIASNIGGKQALETVQRLLPVLCQDHGLTP
EQVVAIASHDGGKQALETVQRLLPVLCQAHGLTPDQVVAIASNGGGKQALETVQRLLPVLCQAHGLTPAQVVAIANNNGGKQALETVQRLLPVLCQD
HGLTPEQVVAIASNGGGRPALESIVAQLSRPDPALAALTNDHLVALACLGGRPALDAVKKGLPHAPALIKRTNRRIPERTSHRVAGSQLVKSELEEK
KSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVE
ENQTRNKHINPNEWWKVYPSSVTEFKFLFVSGHFKGNYKAQLTRLNHITNCNGAVLSVEELLIGGEMIKAGTLTLEEVRRKFNNGEINFRS
```

> CCR5 R551 (+63)

(SEQ ID NO: 294)
```
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCGTCGAATGGCGGGGGAAAGCAAGCC
CTGGAAACCGTGCAAAGGTTGTTGCCGGTCCTTTGTCAAGACCACGGCCTTACACCGGATCAAGTCGTGGCCATTGCAAATAATAACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAACATCGGAGG
GAAACAAGCATTGGAGACTGTCCAACGGCTCCTTCCCGTGTTGTGTCAAGCCCACGGTTTGACGCCTGCACAAGTGGTCGCCATCGCCTCCAACGGT
GGCGGTAAGCAGGCGCTGGAAACAGTACAGCGCCTGCTGCCTGTACTGTGCCAGGATCATGGACTCACCCCAGACCAGGTAGTCGCAATCGCGTCGA
ACATTGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCACATGACGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCAATGGGGGAGGGAAACAAGCATTGGAGACTGTCCAACGGCTCCTTCCCGTGTTGTGTCAAGCCCACGGTTTGACGCCTGCACAAGTGG
TCGCCATCGCCAACAACAACGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAACATTGGGGGAAAGCAAGCCCTGGAAACCGTGCAAAGGTTGTTGCCGGTCCTTTGTCAAGACCACGGCCTTACACCG
GAGCAAGTCGTGGCCATTGCATCACATGACGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCAATGGGGGAGGGAAACAAGCATTGGAGACTGTCCAACGGCTCCTTCCCGTGTTGTGTCAAGCCCACGG
TTTGACGCCTGCACAAGTGGTCGCCATCGCCAACAACAACGGCGGTAAGCAGGCGCTGGAAACAGTACAGCGCCTGCTGCCTGTACTGTGCCAGGAT
CATGGCCTGACACCCGAACAGGTGGTCGCCATTGCTAGCAACGGGGAGGACGGCCAGCCTTGGAGTCCATCGTAGCCCAATTGTCCAGGCCCGATC
CCGCGTTGGCTGCGTTAACGAATGACCATCTGGTGGCGTTGGCATGTCTTGGTGGACGACCCGCGCTCGATGCAGTCAAAAAGGGTCTGCCTCATGC
TCCCGCATTGATCAAAAGAACCAACCGGCGGATTCCCGAGAGAACTTCCCATCGAGTCGCGGGATCCCAGCTGGTGAAGAGCGAGCTGGAGGAGAAG
AAGTCCGAGCTGCGGCACAAGCTGAAGTACGTGCCCCACGAGTACATCGAGCTGATCGAGATCGCCAGGAACAGCACCCAGGACCGCATCCTGGAGA
TGAAGGTGATGGAGTTCTTCATGAAGGTGTACGGCTACAGGGGAAAGCACCTGGGCGGAAGCAGAAAGCCTGACGGCGCCATCTATACAGTGGGCAG
CCCCATCGATTACGGCGTGATCGTGGACACAAAGGCCTACAGCGGCGGCTACAATCTGCCTATCGGCCAGGCCGACGAGATGCAGAGATACGTGGAG
GAGAACCAGACCCGGAATAAGCACATCAACCCCAACGAGTGGTGGAAGGTGTACCCTAGCAGCGTGACCGAGTTCAAGTTCCTGTTCGTGAGCGGCC
```

-continued

ACTTCAAGGGCAACTACAAGGCCCAGCTGACCAGGCTGAACCACATCACCAACTGCAATGGCGCCGTGCTGAGCGTGGAGGAGCTGCTGATCGGCGG
CGAGATGATCAAAGCCGGCACCCTGACACTGGAGGAGGTGCGGCGCAAGTTCAACAACGGCGAGATCAACTTCAGATCT

> CCR5 R557 (+28) (SEQ ID NO: 295)

MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASHDGGKQA
LETVQRLLPVLCQDHGLTPEQVVAIASNGGGKQALETVQRLLPVLCQAHGLTPDQVVAIASNGGGKQALETVQRLLPVLCQAHGLTPAQVVAIASHD
GGKQALETVQRLLPVLCQDHGLTPDQVVAIASHDGGKQALETVQRLLPVLCQDHGLTPEQVVAIASNIGGKQALETVQRLLPVLCQAHGLTPDQVVA
IANNNGGKQALETVQRLLPVLCQAHGLTPAQVVAIASNIGGKQALETVQRLLPVLCQDHGLTPDQVVAIASNIGGKQALETVQRLLPVLCQDHGLTP
EQVVAIASNGGGKQALETVQRLLPVLCQAHGLTPDQVVAIASNGGGKQALETVQRLLPVLCQAHGLTPAQVVAIANNNGGKQALETVQRLLPVLCQD
HGLTPDQVVAIASNIGGKQALETVQRLLPVLCQDHGLTPEQVVAIASNGGGKQALETVQRLLPVLCQAHGLTPDQVVAIASNIGGKQALETVQRLLP
VLCQAHGLTPAQVVAIASHDGGKQALETVQRLLPVLCQDHGLTPEQVVAIASNGGGRPALESIVAQLSRPDPALAALTNDHLVALACLGGSQLVKSE
LEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQ
RYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

> CCR5 R557 (+28) (SEQ ID NO: 296)

ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCGTCGCATGACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCAAACGGAGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGGTTTGACGCCTGCACAAGTGGTCGCCATCGCCTCCCACGAC
GGCGGTAAGCAGGCGCTGGAAACAGTACAGCGCCTGCTGCCTGTACTGTGCCAGGATCATGGACTCACCCCAGACCAGGTAGTCGCAATCGCGTCGC
ATGACGGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAATATCGGTGGCAAACAGGCTCTTGAGACGGTTCAGAGACTTCTCCCAGTTCTCTGTCAAGCCCACGGGCTGACTCCCGATCAAGTTGTAGCG
ATTGCGAATAACAATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCAATATTGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAACATTGGGGGAAAGCAAGCCCTGGAAACCGTGCAAAGGTTGTTGCCGGTCCTTTGTCAAGACCACGGCCTTACACCG
GAGCAAGTCGTGGCCATTGCATCAAACGGAGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCAATGGGCGAGGGAAACAAGCATTGGAGACTGTCCAACGGCTCCTTCCCGTGTTGTGTCAAGCCCACGG
TTTGACGCCTGCACAAGTGGTCGCCATCGCCAACAACAACGGCGCTAAGCAGGCGCTGGAAACAGTACAGCGCCTGCTGCCTGTACTGTGCCAGGAT
CATGGTTTGACCCCAGACCAGGTAGTCGCAATCGCGTCGAACATTGGGGAAAGCAAGCCCTGGAAACCGTGCAAAGGTTGTTGCCGGTCCTTTGTC
AAGACCACGGCCTTACACCGGAGCAAGTCGTGGCCATTGCATCAAACGGAGGTGGCAAACAGGCTCTTGAGACGGTTCAGAGACTTCTCCCAGTTCT
CTGTCAAGCCCACGGGCTGACTCCCGATCAAGTTGTAGCGATTGCGAGCAACATCGGAGGGAAACAAGCATTGGAGACTGTCCAACGGCTCCTTCCC
GTGTTGTGTCAAGCCCACGGTTTGACGCCTGCACAAGTGGTCGCCATCGCCTCCCACGACGGCGGTAAGCAGGCGCTGGAAACAGTACAGCGCCTGC
TGCCTGTACTGTGCCAGGATCATGGCTGACACCCGAACAGGTGGTCGCCATTGCTAGCAACGGGGAGGACGGCCAGCCTTGGAGTCCATCGTAGC
CCAATTGTCCAGGCCCGATCCCGCGTTGGCTGCGTTAACGAATGACCATCTGGTGGCGTTGGCATGTCTTGGTGGATCCCAGCTGGTGAAGAGCGAG
CTGGAGGAGAAGAAGTCCGAGCTGCGGCACAAGCTGAAGTACGTGCCCCACGAGTACATCGAGCTGATCGAGATCGCCAGGAACAGCACCCAGGACC
GCATCCTGGAGATGAAGGTGATGGAGTTCTTCATGAAGGTGTACGGCTACAGGGGAAAGCACCTGGGCGGAAGCAGAAAGCCTGACGGCGCCATCTA
TACAGTGGGCAGCCCCATCGATTACGGCGTGATCGTGGACACAAAGGCCTACAGCGGCGGCTACAATCTGCCTATCGGCCAGGCCGACGAGATGCAG

```
AGATACGTGGAGGAGAACCAGACCCGGAATAAGCACATCAACCCCAACGAGTGGTGGAAGGTGTACCCTAGCAGCGTGACCGAGTTCAAGTTCCTGT
TCGTGAGCGGCCACTTCAAGGGCAACTACAAGGCCCAGCTGACCAGGCTGAACCACATCACCAACTGCAATGGCGCCGTGCTGAGCGTGGAGGAGCT
GCTGATCGGCGGCGAGATGATCAAAGCCGGCACCCTGACACTGGAGGAGGTGCGGCGCAAGTTCAACAACGGCGAGATCAACTTCAGATCT
```

> CCR5 R557 (+63)

(SEQ ID NO: 297)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASHDGGKQA
LETVQRLLPVLCQDHGLTPEQVVAIASNGGGKQALETVQRLLPVLCQAHGLTPDQVVAIASNGGGKQALETVQRLLPVLCQAHGLTPAQVVAIASHD
GGKQALETVQRLLPVLCQDHGLTPDQVVAIASHDGGKQALETVQRLLPVLCQDHGLTPEQVVAIASNIGGKQALETVQRLLPVLCQAHGLTPDQVVA
IANNNGGKQALETVQRLLPVLCQAHGLTPAQVVAIASNIGGKQALETVQRLLPVLCQDHGLTPDQVVAIASNIGGKQALETVQRLLPVLCQDHGLTP
EQVVAIASNGGGKQALETVQRLLPVLCQAHGLTPDQVVAIASNGGGKQALETVQRLLPVLCQAHGLTPAQVVAIANNNGGKQALETVQRLLPVLCQD
HGLTPDQVVAIASNIGGKQALETVQRLLPVLCQDHGLTPEQVVAIASNGGGKQALETVQRLLPVLCQAHGLTPDQVVAIASNIGGKQALETVQRLLP
VLCQAHGLTPAQVVAIASHDGGKQALETVQRLLPVLCQDHGLTPEQVVAIASNGGGRPALESIVAQLSRPDPALAALTNDHLVALACLGGRPALDAV
KKGLPHAPALIKRTNRRIPERTSHRVAGSQLVKSELEEKKSELRHKLKYVPHEYIELIEIARNSTQDRILEMKVMEFFMKVYGYRGKHLGGSRKPDG
AIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSV
EELLIGGEMIKAGTLTLEEVRRKFNNGEINFRS
```

> CCR5 R557 (+63)

(SEQ ID NO: 298)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCGTCGCATGACGGGGGAAAGCAAGCC
CTGGAAACCGTGCAAAGGTTGTTGCCGGTCCTTTGTCAAGACCACGGCCTTACACCGGAGCAAGTCGTGGCCATTGCATCAAACGGAGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGGTTTGACGCCTGCACAAGTGGTCGCCATCGCCTCCCACGAC
GGCGGTAAGCAGGCGCTGGAAACAGTACAGCGCCTGCTGCCTGTACTGTGCCAGGATCATGGACTCACCCCAGACCAGGTAGTCGCAATCGCGTCGC
ATGACGGGGAAAGCAAGCCCTGGAAACCGTGCAAAGGTTGTTGCCGGTCCTTTGTCAAGACCACGGCCTTACACCGGAGCAAGTCGTGGCCATTGC
ATCAAATATCGGTGGCAAACAGGCTCTTGAGACGGTTCAGAGACTTCTCCCAGTTCTCTGTCAAGCCCACGGGCTGACTCCCGATCAAGTTGTAGCG
ATTGCGAATAACAATGGAGGGAAACAAGCATTGGAGACTGTCCAACGGCTCCTTCCCGTGTTGTGTCAAGCCCACGGTTTGACGCCTGCACAAGTGG
TCGCCATCGCCTCCAATATTGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAACATTGGGGAAAGCAAGCCCTGGAAACCGTGCAAAGGTTGTTGCCGGTCCTTTGTCAAGACCACGGCCTTACACCG
GAGCAAGTCGTGGCCATTGCATCAAACGGAGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCAATGGGGGAGGGAAACAAGCATTGGAGACTGTCCAACGGCTCCTTCCCGTGTTGTGTCAAGCCCACGG
TTTGACGCCTGCACAAGTGGTCGCCATCGCCAACAACAACGGCGGTAAGCAGGCGCTGGAAACAGTACAGCGCCTGCTGCCTGTACTGTGCCAGGAT
CATGGTTTGACCCCAGACCAGGTAGTCGCAATCGCGTCGAACATTGGGGAAAGCAAGCCCTGGAAACCGTGCAAAGGTTGTTGCCGGTCCTTTGTC
AAGACCACGGCCTTACACCGGAGCAAGTCGTGGCCATTGCATCAAACGGAGGTGGCAAACAGGCTCTTGAGACGGTTCAGAGACTTCTCCCAGTTCT
CTGTCAAGCCCACGGGCTGACTCCCGATCAAGTTGTAGCGATTGCGAGCAACATCGGAGGGAAACAAGCATTGGAGACTGTCCAACGGCTCCTTCCC
GTGTTGTGTCAAGCCCACGGTTTGACGCCTGCACAAGTGGTCGCCATCGCCTCCCACGACGGCGGTAAGCAGGCGCTGGAAACAGTACAGCGCCTGC
TGCCTGTACTGTGCCAGGATCATGGCCTGACACCCGAACAGGTGGTCGCCATTGCTAGCAACGGGGAGGACGGCCAGCCTTGGAGTCCATCGTAGC
CCAATTGTCCAGGCCCGATCCCGCGTTGGCTGCGTTAACGAATGACCATCTGGTGGCGTTGGCATGTCTTGGTGGACGACCCGCGCTCGATGCAGTC
```

```
AAAAAGGGTCTGCCTCATGCTCCCGCATTGATCAAAAGAACCAACCGGCGGATTCCCGAGAGAACTTCCCATCGAGTCGCGGGATCCCAGCTGGTGA

AGAGCGAGCTGGAGGAGAAGAAGTCCGAGCTGCGGCACAAGCTGAAGTACGTGCCCCACGAGTACATCGAGCTGATCGAGATCGCCAGGAACAGCAC

CCAGGACCGCATCCTGGAGATGAAGGTGATGGAGTTCTTCATGAAGGTGTACGGCTACAGGGGAAAGCACCTGGGCGGAAGCAGAAAGCCTGACGGC

GCCATCTATACAGTGGGCAGCCCCATCGATTACGGCGTGATCGTGGACACAAAGGCCTACAGCGGCGGCTACAATCTGCCTATCGGCCAGGCCGACG

AGATGCAGAGATACGTGGAGGAGAACCAGACCCGGAATAAGCACATCAACCCCAACGAGTGGTGGAAGGTGTACCCTAGCAGCGTGACCGAGTTCAA

GTTCCTGTTCGTGAGCGGCCACTTCAAGGGCAACTACAAGGCCCAGCTGACCAGGCTGAACCACATCACCAACTGCAATGGCGCCGTGCTGAGCGTG

GAGGAGCTGCTGATCGGCGGCGAGATGATCAAAGCCGGCACCCTGACACTGGAGGAGGTGCGGCGCAAGTTCAACAACGGCGAGATCAACTTCAGAT

CT

> CCR5 R560 (+28)                                                                              (SEQ ID NO: 299)
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK

YQDMIAALPEATHEAIVGVGKQWSGARALEALLTVAGELRGPPLQLDTGQLLKIAKRGGVTAVEAVHAWRNALTGAPLNLTPDQVVAIASNGGGKQA

LETVQRLLPVLCQDHGLTPEQVVAIASHDGGKQALETVQRLLPVLCQAHGLTPDQVVAIASNGGGKQALETVQRLLPVLCQAHGLTPAQVVAIASNG

GGKQALETVQRLLPVLCQDHGLTPDQVVAIASHDGGKQALETVQRLLPVLCQDHGLTPEQVVAIASHDGGKQALETVQRLLPVLCQAHGLTPDQVVA

IASNIGGKQALETVQRLLPVLCQAHGLTPAQVVAIANNNGGKQALETVQRLLPVLCQDHGLTPDQVVAIASNIGGKQALETVQRLLPVLCQDHGLTP

EQVVAIASNIGGKQALETVQRLLPVLCQAHGLTPDQVVAIASNGGGKQALETVQRLLPVLCQAHGLTPAQVVAIASNGGGKQALETVQRLLPVLCQD

HGLTPDQVVAIANNNGGKQALETVQRLLPVLCQDHGLTPAQVVAIASNIGGKQALETVQRLLPVLCQDHGLTPEQVVAIASNGGGRPALESIVAQLS

RPDPALAALTNDHLVALACLGGSQLVKSELEEKKSELRHKLKYVPHEYIELIEIARNSTQDRILEMKVMEFFMKVYGYRGKHLGGSRKPDGAIYTVG

SPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIG

GEMIKAGTLTLEEVRRKFNNGEINFRS

> CCR5 R560 (+28)                                                                              (SEQ ID NO: 300)
ATGGACTACAAAGACCATGACGGTGATTATAAAGATCATGACATCGATTACAAGGATGACGATGACAAGATGGCCCCCAAGAAGAAGAGGAAGGTGGG

GCATTCACCGCGGGGTACCTATGGTGGACTTGAGGACACTCGGTTATTCGCAACAGCAACAGGAGAAAATCAAGCCTAAGGTCAGGAGCACCGTCGC

GCAACACCACGAGGCGCTTGTGGGGCATGGCTTCACTCATGCGCATATTGTCGCGCTTTCACAGCACCCTGCGGCGCTTGGGACGGTGGCTGTCAAA

TACCAAGATATGATTGCGGCCCTGCCCGAAGCCACGCACGAGGCAATTGTAGGGGTCGGTAAACAGTGGTCGGGAGCGCGAGCACTTGAGGCGCTGC

TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC

AGTGCACGCCTGGCGCAATGCGCTCACCGGGGCCCCCTTGAACCTGACCCCAGACCAGGTAGTCGCAATCGCGTCGAATGGCGGGGGAAAGCAAGCC

CTGGAAACCGTGCAAAGGTTGTTGCCGGTCCTTTGTCAAGACCACGGCCTTACACCGGAGCAAGTCGTGGCCATTGCATCACATGACGGTGGCAAAC

AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG

GAAACAAGCATTGGAGACTGTCCAACGGCTCCTTCCCGTGTTGTGTCAAGCCCACGGTTTGACGCCTGCACAAGTGGTCGCCATCGCCTCCAACGGT

GGCGGTAAGCAGGCGCTGGAAACAGTACAGCGCCTGCTGCCTGTACTGTGCCAGGATCATGGACTCACCCCAGACCAGGTAGTCGCAATCGCGTCGC

ATGACGGGGAAAGCAAGCCCTGGAAACCGTGCAAAGGTTGTTGCCGGTCCTTTGTCAAGACCACGGCCTTACACCGGAGCAAGTCGTGGCCATTGC

ATCACATGACGGTGGCAAACAGGCTCTTGAGACGGTTCAGAGACTTCTCCCAGTTCTCTGTCAAGCCCACGGGCTGACTCCCGATCAAGTTGTAGCG

ATTGCGAGCAACATCGGAGGGAAACAAGCATTGGAGACTGTCCAACGGCTCCTTCCCGTGTTGTGTCAAGCCCACGGTTTGACGCCTGCACAAGTGG

TCGCCATCGCCAACAACAACGGCGGTAAGCAGGCGCTGGAAACAGTACAGCGCCTGCTGCCTGTACTGTGCCAGGATCATGGGCTGACCCCAGACCA

GGTAGTCGCAATCGCGTCGAACATTGGGGGAAAGCAAGCCCTGGAAACCGTGCAAAGGTTGTTGCCGGTCCTTTGTCAAGACCACGGCCTTACACCG

GAGCAAGTCGTGGCCATTGCATCAAATATCGGTGGCAAACAGGCTCTTGAGACGGTTCAGAGACTTCTCCCAGTTCTCTGTCAAGCCCACGGGCTGA

CTCCCGATCAAGTTGTAGCGATTGCGAGCAATGGGGGAGGGAAACAAGCATTGGAGACTGTCCAACGGCTCCTTCCCGTGTTGTGTCAAGCCCACGG

TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT

CATGGTTTGACCCCAGACCAGGTAGTCGCAATCGCCAACAATAACGGGGGAAAGCAAGCCCTGGAAACCGTGCAAAGGTTGTTGCCGGTCCTTTGTC

AAGACCACGGCCTTACGCCTGCACAAGTGGTCGCCATCGCCTCCAATATTGGCGGTAAGCAGGCGCTGGAAACAGTACAGCGCCTGCTGCCTGTACT

GTGCCAGGATCATGGCCTGACACCCGAACAGGTGGTCGCCATTGCTAGCAACGGGGAGGACGGCCAGCCTTGGAGTCCATCGTAGCCCAATTGTCC
```

-continued

```
AGGCCCGATCCCGCGTTGGCTGCGTTAACGAATGACCATCTGGTGGCGTTGGCATGTCTTGGTGGATCCCAGCTGGTGAAGAGCGAGCTGGAGGAGA
AGAAGTCCGAGCTGCGGCACAAGCTGAAGTACGTGCCCCACGAGTACATCGAGCTGATCGAGATCGCCAGGAACAGCACCCAGGACCGCATCCTGGA
GATGAAGGTGATGGAGTTCTTCATGAAGGTGTACGGCTACAGGGGAAAGCACCTGGGCGGAAGCAGAAAGCCTGACGGCGCCATCTATACAGTGGGC
AGCCCCATCGATTACGGCGTGATCGTGGACACAAAGGCCTACAGCGGCGGCTACAATCTGCCTATCGGCCAGGCCGACGAGATGCAGAGATACGTGG
AGGAGAACCAGACCCGGAATAAGCACATCAACCCCAACGAGTGGTGGAAGGTGTACCCTAGCAGCGTGACCGAGTTCAAGTTCCTGTTCGTGAGCGG
CCACTTCAAGGGCAACTACAAGGCCCAGCTGACCAGGCTGAACCACATCACCAACTGCAATGGCGCCGTGCTGAGCGTGGAGGAGCTGCTGATCGGC
GGCGAGATGATCAAAGCCGGCACCCTGACACTGGAGGAGGTGCGGCGCAAGTTCAACAACGGCGAGATCAACTTCAGATCT
```

> CCR5 R560 (+63)                                                                      (SEQ ID NO: 301)

```
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASNGGGKQA
LETVQRLLPVLCQDHGLTPEQVVAIASHDGGKQALETVQRLLPVLCQAHGLTPDQVVAIASNGGGKQALETVQRLLPVLCQAHGLTPAQVVAIASNG
GGKQALETVQRLLPVLCQDHGLTPDQVVAIASHDGGKQALETVQRLLPVLCQDHGLTPEQVVAIASHDGGKQALETVQRLLPVLCQAHGLTPDQVVA
IASNIGGKQALETVQRLLPVLCQAHGLTPAQVVAIANNNGGKQALETVQRLLPVLCQDHGLTPDQVVAIASNIGGKQALETVQRLLPVLCQDHGLTP
EQVVAIASNIGGKQALETVQRLLPVLCQAHGLTPDQVVAIASNGGGKQALETVQRLLPVLCQAHGLTPAQVVAIASNGGGKQALETVQRLLPVLCQD
HGLTPDQVVAIANNNGGKQALETVQRLLPVLCQDHGLTPAQVVAIASNIGGKQALETVQRLLPVLCQDHGLTPEQVVAIASNGGGRPALESIVAQLS
RPDPALAALTNDHLVALACLGGRPALDAVKKGLPHAPALIKRTNRRIPERTSHRVAGSQLVKSELEEKKSELRHKLKYVPHEYIELIEIARNSTQDR
ILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLF
VSGHFKGNYKAQLTRLNHITNCNGAVLSVEELLIGGEMIKAGTLTLEEVRRKFNNGEINFRS
```

> CCR5 R560 (+63)                                                                      (SEQ ID NO: 302)

```
ATGGACTACAAAGACCATGACGGTGATTATAAAGATCATGACATCGATTACAAGGATGACGATGACAAGATGGCCCCCAAGAAGAAGAGGAAGGTGG
GCATTCACCGCGGGGTACCTATGGTGGACTTGAGGACACTCGGTTATTCGCAACAGCAACAGGAGAAAATCAAGCCTAAGGTCAGGAGCACCGTCGC
GCAACACCACGAGGCGCTTGTGGGGCATGGCTTCACTCATGCGCATATTGTCGCGCTTTCACAGCACCCTGCGGCGCTTGGGACGGTGGCTGTCAAA
TACCAAGATATGATTGCGGCCCTGCCCGAAGCCACGCACGAGGCAATTGTAGGGGTCGGTAAACAGTGGTCGGGAGCGCGAGCACTTGAGGCGCTGC
TGACTGTGGCGGGTGAGCTTAGGGGGCCTCCGCTCCAGCTCGACACCGGGCAGCTGCTGAAGATCGCGAAGAGAGGGGGAGTAACAGCGGTAGAGGC
AGTGCACGCCTGGCGCAATGCGCTCACCGGGGCCCCCTTGAACCTGACCCCAGACCAGGTAGTCGCAATCGCGTCGAATGGCGGGGGAAAGCAAGCC
CTGGAAACCGTGCAAAGGTTGTTGCCGGTCCTTTGTCAAGACCACGGCCTTACACCGGAGCAAGTCGTGGCCATTGCATCACATGACGGTGGCAAAC
AGGCTCTTGAGACGGTTCAGAGACTTCTCCCAGTTCTCTGTCAAGCCCACGGGCTGACTCCCGATCAAGTTGTAGCGATTGCGAGCAATGGGGGAGG
GAAACAAGCATTGGAGACTGTCCAACGGCTCCTTCCCGTGTTGTGTCAAGCCCACGGTTTGACGCCTGCACAAGTGGTCGCCATCGCCTCCAACGGT
GGCGGTAAGCAGGCGCTGGAAACAGTACAGCGCCTGCTGCCTGTACTGTGCCAGGATCATGGACTCACCCCAGACCAGGTAGTCGCAATCGCGTCGC
ATGACGGGGAAAGCAAGCCCTGGAAACCGTGCAAAGGTTGTTGCCGGTCCTTTGTCAAGACCACGGCCTTACACCGGAGCAAGTCGTGGCCATTGC
ATCACATGACGGTGGCAAACAGGCTCTTGAGACGGTTCAGAGACTTCTCCCAGTTCTCTGTCAAGCCCACGGGCTGACTCCCGATCAAGTTGTAGCG
ATTGCGAGCAACATCGGAGGGAAACAAGCATTGGAGACTGTCCAACGGCTCCTTCCCGTGTTGTGTCAAGCCCACGGTTTGACGCCTGCACAAGTGG
TCGCCATCGCCAACAACAACGGCGGTAAGCAGGCGCTGGAAACAGTACAGCGCCTGCTGCCTGTACTGTGCCAGGATCATGGGCTGACCCCAGACCA
GGTAGTCGCAATCGCGTCGAACATTGGGGGAAAGCAAGCCCTGGAAACCGTGCAAAGGTTGTTGCCGGTCCTTTGTCAAGACCACGGCCTTACACCG
GAGCAAGTCGTGGCCATTGCATCAAATATCGGTGGCAAACAGGCTCTTGAGACGGTTCAGAGACTTCTCCCAGTTCTCTGTCAAGCCCACGGGCTGA
CTCCCGATCAAGTTGTAGCGATTGCGAGCAATGGGGGAGGGAAACAAGCATTGGAGACTGTCCAACGGCTCCTTCCCGTGTTGTGTCAAGCCCACGG
TTTGACGCCTGCACAAGTGGTCGCCATCGCCTCCAACGGTGGCGGTAAGCAGGCGCTGGAAACAGTACAGCGCCTGCTGCCTGTACTGTGCCAGGAT
CATGGTTTGACCCCAGACCAGGTAGTCGCAATCGCCAACAATAACGGGGGAAAGCAAGCCCTGGAAACCGTGCAAAGGTTGTTGCCGGTCCTTTGTC
AAGACCACGGCCTTACGCCTGCACAAGTGGTCGCCATCGCCTCCAATATTGGCGGTAAGCAGGCGCTGGAAACAGTACAGCGCCTGCTGCCTGTACT
GTGCCAGGATCATGGCCTGACACCCGAACAGGTGGTCGCCATTGCTAGCAACGGGGGAGGACGGCCAGCCTTGGAGTCCATCGTAGCCCAATTGTCC
```

```
AGGCCCGATCCCGCGTTGGCTGCGTTAACGAATGACCATCTGGTGGCGTTGGCATGTCTTGTGGACGACCCGCGCTCGATGCAGTCAAAAAGGGTC

TGCCTCATGCTCCCGCATTGATCAAAAGAACCAACCGGCGGATTCCCGAGAGAACTTCCCATCGAGTCGCGGGATCCCAGCTGGTGAAGAGCGAGCT

GGAGGAGAAGAAGTCCGAGCTGCGGCACAAGCTGAAGTACGTGCCCCACGAGTACATCGAGCTGATCGAGATCGCCAGGAACAGCACCCAGGACCGC

ATCCTGGAGATGAAGGTGATGGAGTTCTTCATGAAGGTGTACGGCTACAGGGGAAAGCACCTGGGCGGAAGCAGAAAGCCTGACGGCGCCATCTATA

CAGTGGGCAGCCCCATCGATTACGGCGTGATCGTGGACACAAAGGCCTACAGCGGCGGCTACAATCTGCCTATCGGCCAGGCCGACGAGATGCAGAG

ATACGTGGAGGAGAACCAGACCCGGAATAAGCACATCAACCCCAACGAGTGGTGGAAGGTGTACCCTAGCAGCGTGACCGAGTTCAAGTTCCTGTTC

GTGAGCGGCCACTTCAAGGGCAACTACAAGGCCCAGCTGACCAGGCTGAACCACATCACCAACTGCAATGGCGCCGTGCTGAGCGTGGAGGAGCTGC

TGATCGGCGGCGAGATGATCAAAGCCGGCACCCTGACACTGGAGGAGGTGCGGCGCAAGTTCAACAACGGCGAGATCAACTTCAGATCT
```

CCR5 Donor Sequence:

(SEQ ID NO: 176)

```
5'AGCGCCCAATACGCAAACCGCCTCTCCCCGCGCGTTGGCCGATTCATTAATGCAGCTGGCACGACAG

GTTTCCCGACTGGAAAGCGGGCAGTGAGCGCAACGCAATTAATGTGAGTTAGCTCACTCATTAGGCAC

CCCAGGCTTTACACTTTATGCTTCCGGCTCGTATGTTGTGTGGAATTGTGAGCGGATAACAATTTCACA

CAGGAAACAGCTATGACCATGATTACGCCAAGCTCAGAATTAACCCTCACTAAAGGGACTAGTCCTGC

AGGTTTAAACGAATTCGCCCTTGATACTTATTAACCATACCTTGGAGGGGAAATCACACATGAAAGT

GTCATTTCTTTACTAATCATATTCATGTCTTTTCTCCCCATAGCAAGACAAAGACCTGTTTTAAACACAT

TTACAACCTATATGTTGCCTTGTACTAGGTAAAAAGTTGTACATTTCTGAAATAATTTTGGTATTTCTGT

TCAGATCACTAAACTCAAGAATCAGCAATTCTCTGAGGCTTTCTTTTAAATATACATAAGGAACTTTCG

GAGTGAAGGGAGAGTTTGTCAATAACTTGATGCATGTGAAGGGGAGATAAAAAGGTTGCTATTTTTCA

TCAACATATTTTGATTTGGCTTTCTATAATTGATGGGCTTAAAAGATCTAATCTACTTTAAACAGATGC

CAAATAAATGGATGAATCTTAGACCCTCTATAACAGTAACTTCCTTTTAAAAAGACCTCTCCCACCCC

ACCCCCAGCCCAGGCTGTGTATGAAAACTAAGCCATGTGCACAACTCTGACTGGGTCACCAGCCCACT

TGAGTCCGTGTCACAAGCCCACAGATATTTCCTGCTCCCCAGTGGATCGGGTGTAAACTGAGCTTGCTC

GCTCGGGAGCCTCTTGCTGGAAAATAGAACAGCATTTGCAGAAGCGTTTGGCAATGTGCTTTTGGAAG

AAGACTAAGAGGTAGTTTCTGAACTTCTCCCCGACAAAGGCATAGATGATGGGGTTGATGCAGCAGTG

CGTCATCCCAAGAGTCTCTGTCACCTGCATAGCTTGGTCCAACCTGTTAGAGCTACTGCAATTATTCAG

GCCAAAGAATTCCTGGAAGGTGTTCAGGAGAAGGACAATGTTGTAGGGAGCCCAGAAGAGAAATAA

ACAATCATGATGGTGAAGATAAGCCTCACAGCCCTGTGCCTCTTCTTCTCATTTCGACACCGAAGCAG

AGTTTTTAGGATTCCCGAGTAGCAGATGACCATGACAAGCAGCGGCAGGACCAGCCCCAAGATGACT

ATCTTTAATGTCTGGAAATTCTTCCAGAATTGATACTGACTGTATGGAAAATGAGAGCTGCAGGTGTA

ATGAAGACCTTCTTTTTGAGATCTGGTAAAGATGATTCCTGGGAGAGACGCAAACACAGCCACCACCC

AAGTGATCACACTTGTCACCACCCCAAAGGTGACCGTCCTGGCTTTTAAAGCAAACACAGCATGGACG

ACAGCCAGGTACCTATCGATTGTCAGGAGGATGATGAAGAAGATTCCAGAGAAGAAGCCTATAAAAT

AGAGCCCTGTCAAGAGTTGACACATTGTATTTCCAAAGTCCCACTGGGCGGCAGCATAGTGAGCCCAG

AAGGGGACAGTAAGAAGGAAAAACAGGTCAGAGATGGCCAGGTTGAGCAGGTAGATGTCAGTCATGC

TCTTCAGCCTTTTGCAGTTTTCTAGACGAGGCATCCAGTCCAGACGCCATCAGGGCATACTCACTGATC

TAGATGAGGATGACCAGCATGTTGCCCACAAAACCAAAGATGAACACCAGTGAGTAGAGCGGAGGCA

GGAGGCGGGCTGCGATTTGCTTCACATTGATTTTTTGGCAGGGCTCCGATGTATAATAATTGATGTCAT

AGATTGGACTTGACACTTGATAATCCATCTTGTTCCACCCTGTGCATAAATAAAAGTGATCTTTTATA

AAGTCCTAGAATGTATTTAGTTGCCCTCCATGAATGCAAACTGTTTTATACATCAATAGGTTTTTAATT

GCCTACATGATGTCTACATTGAATTAACTCTCTTTTTGGCCAAGCAATGAAGTTTTGTAGTGAAGGGA

AGGTTTGCTGCTAGCTTCCCTGTCCACTAGATGGAGAGCTTGGCTCTGTTGGGGAATTCATGAAAGC
```

```
ACCATCTCACCAAATAAAATCTTGTGCTCTATAGCACCATGGAGTGAATGAAGCTTTGACAACAATTA
AGGGCGAATTCGCGGCCGCTAAATTCAATTCGCCCTATAGTGAGTCGTATTACAATTCACTGGCCGTC
GTTTTACAACGTCGTGACTGGGAAAACCCTGGCGTTACCCAACTTAATCGCCTTGCAGCACATCCCCT
TTCGCCAGCTGGCGTAATAGCGAAGAGGCCCGCACCGATCGCCCTTCCCAACAGTTGCGCAGCCTATA
CGTACGGCAGTTTAAGGTTTACACCTATAAAAGAGAGAGCCGTTATCGTCTGTTTGTGGATGTACAGA
GTGATATTATTGACACGCCGGGGCGACGGATGGTGATCCCCCTGGCCAGTGCACGTCTGCTGTCAGAT
AAAGTCTCCCGTGAACTTTACCCGGTGGTGCATATCGGGGATGAAAGCTGGCGCATGATGACCACCGA
TATGGCCAGTGTGCCGGTCTCCGTTATCGGGGAAGAAGTGGCTGATCTCAGCCACCGCGAAAATGACA
TCAAAAACGCCATTAACCTGATGTTCTGGGGAATATAAATGTCAGGCATGAGATTATCAAAAGGATC
TTCACCTAGATCCTTTTCACGTAGAAAGCCAGTCCGCAGAAACGGTGCTGACCCCGGATGAATGTCAG
CTACTGGGCTATCTGGACAAGGGAAAACGCAAGCGCAAGAGAAAGCAGGTAGCTTGCAGTGGGCTT
ACATGGCGATAGCTAGACTGGGCGGTTTTATGGACAGCAAGCGAACCGGAATTGCCAGCTGGGGCGC
CCTCTGGTAAGGTTGGGAAGCCCTGCAAAGTAAACTGGATGGCTTTCTTGCCGCCAAGGATCTGATGG
CGCAGGGGATCAAGCTCTGATCAAGAGACAGGATGAGGATCGTTTCGCATGATTGAACAAGATGGAT
TGCACGCAGGTTCTCCGGCCGCTTGGGTGGAGAGGCTATTCGGCTATGACTGGGCACAACAGACAATC
GGCTGCTCTGATGCCGCCGTGTTCCGGCTGTCAGCGCAGGGGCGCCCGGTTCTTTTTGTCAAGACCGAC
CTGTCCGGTGCCCTGAATGAACTGCAAGACGAGGCAGCGCGGCTATCGTGGCTGGCCACGACGGGCGT
TCCTTGCGCAGCTGTGCTCGACGTTGTCACTGAAGCGGGAAGGGACTGGCTGCTATTGGGCGAAGTGC
CGGGGCAGGATCTCCTGTCATCTCACCTTGCTCCTGCCGAGAAAGTATCCATCATGGCTGATGCAATGC
GGCGGCTGCATACGCTTGATCCGGCTACCTGCCCATTCGACCACCAAGCGAAACATCGCATCGAGCGA
GCACGTACTCGGATGGAAGCCGGTCTTGTCGATCAGGATGATCTGGACGAAGAGCATCAGGGGCTCGC
GCCAGCCGAACTGTTCGCCAGGCTCAAGGCGAGCATGCCCGACGGCGAGGATCTCGTCGTGACCCATG
GCGATGCCTGCTTGCCGAATATCATGGTGGAAAATGGCCGCTTTTCTGGATTCATCGACTGTGGCCGGC
TGGGTGTGGCGGACCGCTATCAGGACATAGCGTTGGCTACCCGTGATATTGCTGAAGAGCTTGGCGGC
GAATGGGCTGACCGCTTCCTCGTGCTTTACGGTATCGCCGCTCCCGATTCGCAGCGCATCGCCTTCTAT
CGCCTTCTTGACGAGTTCTTCTGAATTATTAACGCTTACAATTTCCTGATGCGGTATTTTCTCCTTACGC
ATCTGTGCGGTATTTCACACCGCATCAGGTGGCACTTTTCGGGGAAATGTGCGCGGAACCCCTATTTGT
TTATTTTTCTAAATACATTCAAATATGTATCCGCTCATGAGATTATCAAAAAGGATCTTCACCTAGATC
CTTTTAAATTAAAAATGAAGTTTTAAATCAATCTAAAGTATATATGAGTAAACTTGGTCTGACAGTTAC
CAATGCTTAATCAGTGAGGCACCTATCTCAGCGATCTGTCTATTTCGTTCATCCATAGTTGCCTGACTC
CCCGTCGTGTAGATAACTACGATACGGGAGGGCTTACCATCTGGCCCCAGTGCTGCAATGATACCGCG
AGACCCACGCTCACCGGCTCCAGATTTATCAGCAATAAACCAGCCAGCCGGAAGGGCCGAGCGCAGA
AGTGGTCCTGCAACTTTATCCGCCTCCATCCAGTCTATTAATTGTTGCCGGGAAGCTAGAGTAAGTAGT
TCGCCAGTTAATAGTTTGCGCAACGTTGTTGCCATTGCTACAGGCATCGTGGTGTCACGCTCGTCGTTT
GGTATGGCTTCATTCAGCTCCGGTTCCCAACGATCAAGGCGAGTTACATGATCCCCCATGTTGTGCAAA
AAAGCGGTTAGCTCCTTCGGTCCTCCGATCGTTGTCAGAAGTAAGTTGGCCGCAGTGTTATCACTCATG
GTTATGGCAGCACTGCATAATTCTCTTACTGTCATGCCATCCGTAAGATGCTTTTCTGTGACTGGTGAG
TACTCAACCAAGTCATTCTGAGAATAGTGTATGCGGCGACCGAGTTGCTCTTGCCCGGCGTCAATACG
GGATAATACCGCGCCACATAGCAGAACTTTAAAAGTGCTCATCATTGGAAAACGTTCTTCGGGGCGAA
AACTCTCAAGGATCTTACCGCTGTTGAGATCCAGTTCGATGTAACCCACTCGTGCACCCAACTGATCTT
```

-continued

CAGCATCTTTTACTTTCACCAGCGTTTCTGGGTGAGCAAAAACAGGAAGGCAAATGCCGCAAAAAG

GGAATAAGGGCGACACGGAAATGTTGAATACTCATACTCTTCCTTTTTCAATATTATTGAAGCATTTAT

CAGGGTTATTGTCTCATGACCAAAATCCCTTAACGTGAGTTTTCGTTCCACTGAGCGTCAGACCCCGTA

GAAAAGATCAAAGGATCTTCTTGAGATCCTTTTTTTCTGCGCGTAATCTGCTGCTTGCAAACAAAAAAA

CCACCGCTACCAGCGGTGGTTTGTTTGCCGGATCAAGAGCTACCAACTCTTTTTCCGAAGGTAACTGGC

TTCAGCAGAGCGCAGATACCAAATACTGTTCTTCTAGTGTAGCCGTAGTTAGGCCACCACTTCAAGAA

CTCTGTAGCACCGCCTACATACCTCGCTCTGCTAATCCTGTTACCAGTGGCTGCTGCCAGTGGCGATAA

GTCGTGTCTTACCGGGTTGGACTCAAGACGATAGTTACCGGATAAGGCGCAGCGGTCGGGCTGAACGG

GGGGTTCGTGCACACAGCCCAGCTTGGAGCGAACGACCTACACCGAACTGAGATACCTACAGCGTGA

GCTATGAGAAAGCGCCACGCTTCCCGAAGGGAGAAAGGCGGACAGGTATCCGGTAAGCGGCAGGGTC

GGAACAGGAGAGCGCACGAGGGAGCTTCCAGGGGGAAACGCCTGGTATCTTTATAGTCCTGTCGGGTT

TCGCCACCTCTGACTTGAGCGTCGATTTTTGTGATGCTCGTCAGGGGGGCGGAGCCTATGGAAAAACG

CCAGCAACGCGGCCTTTTTACGGTTCCTGGCCTTTTGCTGGCCTTTTGCTCACATGTTCTTTCCTGCGTT

ATCCCCTGATTCTGTGGATAACCGTATTACCGCCTTTGAGTGAGCTGATACCGCTCGCCGCAGCCGAAC

GACCGAGCGCAGCGAGTCAGTGAGCGAGGAAGCGGAAG3'

3. TALE Constructs and Protein Sequences Used Gene Activation Studies
Complete TALE Construct Sequence, with Coding Sequence Underlined (SEQ ID NO:303):

TAATACGACTCACTATAGGGAGACCCAAGCTGGCTAGCTTAAGCTGATCCACTAGTCCAGTGTGGTGGAATTCGCTAGCGCCACC<u>ATGGCCCCCAAG</u>

<u>AAGAAGAGGAAGGTGGGAATCGATGGGGTACCCGCCGCTGTGGATCTACGCACGCTCGGCTACAGCCAGCAGCAACAGGAGAAGATCAAACCGAAGG</u>

<u>TTCGTTCGACAGTGGCGCAGCACCACGAGGCACTGGTCGGCCATGGGTTTACACACGCGCACATCGTTGCGCTCAGCCAACACCCGGCAGCGTTAGG</u>

<u>GACCGTCGCTGTCAAGTATCAGGACATGATCGCAGCGTTGCCAGAGGCGACACACGAAGCGATCGTTGGCGTCGGCAAACAGTGGTCCGGCGCACGC</u>

<u>GCCCTGGAGGCCTTGCTCACGGTGGCGGGAGAGTTGAGAGGTCCACCGTTACAGTTGGACACAGGCCAACTTCTCAAGATTGCAAAACGTGGCGGCG</u>

<u>TGACCGCAGTGGAGGCAGTGCATGCATGGCGCAATGCACTGACGGGGCCCCCCTGAACCTGACCCCGGAGCAGGTGGTGGCCATCGCCAGCAATAT</u>

<u>TGGTGGCAAGCAGGCGCTGGAGACGGTGCAGCGGCTGTTGCCGGTGCTGTGCCAGGCCCATGGCCTGACCCCGGAGCAGGTGGTGGCCATCGCCAGC</u>

<u>AATGGCGGCAAGCAGGCGCTGGAGACGGTGCAGCGGCTGTTGCCGGTGCTGTGCCAGGCCCATGGCCTGACCCCGGAGCAGGTGGTGGCCATCGCCA</u>

<u>GCAATATTGGTGGCAAGCAGGCGCTGGAGACGGTGCAGCGGCTGTTGCCGGTGCTGTGCCAGGCCCATGGCCTGACCCCGGAGCAGGTGGTGGCCAT</u>

<u>CGCCAGCAATATTGGTGGCAAGCAGGCGCTGGAGACGGTGCAGCGGCTGTTGCCGGTGCTGTGCCAGGCCCATGGCCTGACCCCGGCACAGGTGGTG</u>

<u>GCCATCGCCAGCAATATTGGCGGCAAGCAGGCGCTGGAGACGGTGCAGCGGCTGTTGCCGGTGCTGCGCCAGGCCCATGGCCTGACCCCGGAGCAGG</u>

<u>TCGTGGCCATCGCCAGCAATGGCGGCAAGCAGGCGCTGGAGACGGTGCAGCGGCTGTTGCCGGTGCTGTGCCAGGCCCATGGCCTGACCCCGGCACA</u>

<u>GGTGGTGGCCATCGCCAGCAATATTGGCGGCAAGCAGGCGCTGGAGACGGTGCAGCGGCTGTTGCCGGTGCTGTGCCAGGCCCATGGCCTGACCCCG</u>

<u>GAGCAGGTCGTGGCCATCGCCAGCCACGATGGCGGCAAGCAGGCGCTGGAGACGGTGCAGCGGCTGTTGCCGGTGCTGTGCCAGGCCCATGGCCTGA</u>

<u>CCCCGGAGCAGGTGGTGGCCATCGCCAGCCACGATGGCGGCAAGCAGGCGCTGGAGACGGTGCAGCGGCTGTTGCCGGTGCTGTGCCAGGCCCATGG</u>

<u>CCTGACCCCGGACCAGGTGGTGGCCATCGCCAGCAATGGCGGTGGCAAGCAGGCGCTGGAGACGGTGCAGCGGCTGTTGCCGGTGCTGTGCCAGGCC</u>

<u>CATGGCCTGACCCCGGACCAGGTGGTGGCCATCGCCAGCAATGGCGGTGGCAAGCAGGCGCTGGAGACGGTGCAGCGGCTGTTGCCGGTGCTGTGCC</u>

<u>AGGCCCATGGCCTGACCCCGGAGCAGGTGGTGGCCATCGCCAGCCACGATGGCGGCAAGCAGGCGCTGGAGACGGTGCAGCGGCTGTTGCCGGTGCT</u>

<u>GTGCCAGGCCCATGGCCTGACCCCGGAGCAGGTGGTGGCCATCGCCAGCAATGGCGGCGGCAGGCCGGCGCTGGAGAGCATTGTTGCCCAGTTATCT</u>

<u>CGCCCTGATCCGGCGTTGGCCGCGTTAACCAACGACCACCTCGTCGCCTTGGCCTGCCTCGGCGGACGTCCTGCGCTGGATGCAGTGAAAAAGGGAT</u>

<u>TGCCGCACGCGCCGGCCTTGATCAAAAGAACCAATCGCCGTATTCCCGAACGCACATCCCATCGCGTTGCCGACCACGCGCAAGTGGTTCGCGTGCT</u>

<u>GGGTTTTTTCCAGTGCCACTCCCACCCAGCGCAAGCATTTGATGACGCCATGACGCAGTTCGGGATGAGCAGGCACGGGTTGTTACAGCTCTTTCGC</u>

AGAGTGGGCGTCACCGAACTCGAAGCCCGCAGTGGAACGCTCCCCCCAGCCTCGCAGCGTTGGGACCGTATCCTCCAGGCATCAGGGATGAAAAGGG
CCAAACCGTCCCCTACTTCAACTCAAACGCCGGACCAGGCGTCTTTGCATGCATTCGCCGATTCGCTGGAGCGTGACCTTGATGCGCCCAGCCCAAC
GCACGAGGGAGATCAGAGGCGGGCAAGCAGCCGTAAACGGTCCCGATCGGATCGTGCTGTCACCGGTCCCTCCGCACAGCAATCGTTCGAGGTGCGC
GCTCCCGAACAGCGCGATGCGCTGCATTTGCCCCTCAGTTGGAGGGTAAAACGCCCGCGTACCAGTATCGGGGCGGCCTCCCGGATCCTGGTACGC
CCACGGCTGCCGACCTGGCAGCGTCCAGCACCGTGATGCGGGAACAAGATGAGGACCCCTTCGCAGGGGCAGCGGATGATTTCCCGGCATTCAACGA
AGAGGAGCTCGCATGGTTGATGGAGCTATTGCCTCAGGACCGCGGCCGCGCCCCCCGACCGATGTCAGCCTGGGGACGAGCTCCACTTAGACGGC
GAGGACGTGGCGATGGCGCATGCCGACGCGCTAGACGATTTCGATCTGGACATGTTGGGGGACGGGGATTCCCCGGGTCCGGATTTACCCCCCACG
ACTCCGCCCCCTACGGCGCTCTGGATATGGCCGACTTCGAGTTTGAGCAGATGTTTACCGATGCCCTTGGAATTGACGAGTACGGTGGCGGCCGCGA
CTACAAGGACGACGATGACAAGTAAGCTTCTCGAGTCTAGCTAGTTTAAACCCGCTGATCAGCCTCGACTGTGCCTTCTAGTTGCCAGCCATCTGTT
GTTTGCCCCTCCCCCGTGCCTTCCTTGACCCTGGAAGGTGCCACTCCCACTGTCCTTTCCTAATAAAATGAGGAAATTGCATCGCATTGTCTGAGTA
GGTGTCATTCTATTCTGGGGGGTGGGGTGGGCAGGACAGCAAGGGGGAGGATTGGGAAGACAATAGCAGGCATGCTGGGGATGCGGTGGGCTCTAT
GGCTTCTGAGGCGGAAAGAACCAGCTGGGGCTCTAGGGGGTATCCCCACGCGCCCTGTAGCGGCGCATTAAGCGCGGCGGGTGTGGTGGTTACGCGC
AGCGTGACCGCTACACTTGCCAGCGCCCTAGCGCCCGCTCCTTTCGCTTTCTTCCCTTCCTTTCTCGCCACGTTCGCCGGCTTTCCCCGTCAAGCTC
TAAATCGGGGCATCCCTTTAGGGTTCCGATTTAGTGCTTTACGGCACCTCGACCCCAAAAAACTTGATTAGGGTGATGGTTCACGTAGTGGGCCATC
GCCCTGATAGACGGTTTTTCGCCCTTTGACGTTGGAGTCCACGTTCTTTAATAGTGGACTCTTGTTCCAAACTGGAACAACACTCAACCCTATCTCG
GTCTATTCTTTTGATTTATAAGGGATTTTGGGGATTTCGGCCTATTGGTTAAAAAATGAGCTGATTTAACAAAAATTTAACGCGAATTAATTCTGTG
GAATGTGTGTCAGTTAGGGTGTGGAAAGTCCCCAGGCTCCCCAGGCAGGCAGAAGTATGCAAAGCATGCATCTCAATTAGTCAGCAACCAGGTGTGG
AAAGTCCCCAGGCTCCCCAGCAGGCAGAAGTATGCAAAGCATGCATCTCAATTAGTCAGCAACCATAGTCCCGCCCCTAACTCCGCCCATCCCGCCC
CTAACTCCGCCCAGTTCCGCCCATTCTCCGCCCCATGGCTGACTAATTTTTTTTATTTATGCAGAGGCCGAGGCCGCCTCTGCCTCTGAGCTATTCC
AGAAGTAGTGAGGAGGCTTTTTTGGAGGCCTAGGCTTTTGCAAAAAGCTCCCGGGAGCTTGTATATCCATTTTCGGATCTGATCAAGAGACAGGATG
AGGATCGTTTCGCATGATTGAACAAGATGGATTGCACGCAGGTTCTCCGGCCGCTTGGGTGGAGAGGCTATTCGGCTATGACTGGGCACAACAGACA
ATCGGCTGCTCTGATGCCGCCGTGTTCCGGCTGTCAGCGCAGGGGCGCCCGGTTCTTTTTGTCAAGACCGACCTGTCCGGTGCCCTGAATGAACTGC
AGGACGAGGCAGCGCGGCTATCGTGGCTGGCCACGACGGGCGTTCCTTGCGCAGCTGTGCTCGACGTTGTCACTGAAGCGGGAAGGGACTGGCTGCT
ATTGGGCGAAGTGCCGGGGCAGGATCTCCTGTCATCTCACCTTGCTCCTGCCGAGAAAGTATCCATCATGGCTGATGCAATGCGGCGGCTGCATACG
CTTGATCCGGCTACCTGCCCATTCGACCACCAAGCGAAACATCGCATCGAGCGAGCACGTACTCGGATGGAAGCCGGTCTTGTCGATCAGGATGATC
TGGACGAAGAGCATCAGGGGCTCGCGCCAGCCGAACTGTTCGCCAGGCTCAAGGCGCGCATGCCCGACGGCGAGGATCTCGTCGTGACCCATGGCGA
TGCCTGCTTGCCGAATATCATGGTGGAAAATGGCCGCTTTTCTGGATTCATCGACTGTGGCCGGCTGGGTGTGGCGGACCGCTATCAGGACATAGCG
TTGGCTACCCGTGATATTGCTGAAGAGCTTGGCGGCGAATGGGCTGACCGCTTCCTCGTGCTTTACGGTATCGCCGCTCCCGATTCGCAGCGCATCG
CCTTCTATCGCCTTCTTGACGAGTTCTTCTGAGCGGGACTCTGGGGTTCGAAATGACCGACCAAGCGACGCCCAACCTGCCATCACGAGATTTCGAT
TCCACCGCCGCCTTCTATGAAAGGTTGGGCTTCGGAATCGTTTTCCGGGACGCCGGCTGGATGATCCTCCAGCGCGGGGATCTCATGCTGGAGTTCT
TCGCCCACCCCAACTTGTTTATTGCAGCTTATAATGGTTACAAATAAAGCAATAGCATCACAAATTTCACAAATAAAGCATTTTTTTCACTGCATTC
TAGTTGTGGTTTGTCCAAACTCATCAATGTATCTTATCATGTCTGTATACCGTCGACCTCTAGCTAGAGCTTGGCGTAATCATGGTCATAGCTGTTT
CCTGTGTGAAATTGTTATCCGCTCACAATTCCACACAACATACGAGCCGGAAGCATAAAGTGTAAAGCCTGGGGTGCCTAATGAGTGAGCTAACTCA
CATTAATTGCGTTGCGCTCACTGCCCGCTTTCCAGTCGGGAAACCTGTCGTGCCAGCTGCATTAATGAATCGGCCAACGCGCGGGGAGAGGCGGTTT
GCGTATTGGGCGCTCTTCCGCTTCCTCGCTCACTGACTCGCTGCGCTCGGTCGTTCGGCTGCGGCGAGCGGTATCAGCTCACTCAAAGGCGGTAATA
CGGTTATCCACAGAATCAGGGGATAACGCAGGAAAGAACATGTGAGCAAAAGGCCAGCAAAAGGCCAGGAACCGTAAAAAGGCCGCGTTGCTGGCGT
TTTTCCATAGGCTCCGCCCCCCTGACGAGCATCACAAAAATCGACGCTCAAGTCAGAGGTGGCGAAACCCGACAGGACTATAAAGATACCAGGCGTT
TCCCCCTGGAAGCTCCCTCGTGCGCTCTCCTGTTCCGACCCTGCCGCTTACCGGATACCTGTCCGCCTTTCTCCCTTCGGGAAGCGTGGCGCTTTCT
CAATGCTCACGCTGTAGGTATCTCAGTTCGGTGTAGGTCGTTCGCTCCAAGCTGGGCTGTGTGCACGAACCCCCCGTTCAGCCCGACCGCTGCGCCT
TATCCGGTAACTATCGTCTTGAGTCCAACCCGGTAAGACACGACTTATCGCCACTGGCAGCAGCCACTGGTAACAGGATTAGCAGAGCGAGGTATGT

```
                                              -continued
AGGCGGTGCTACAGAGTTCTTGAAGTGGTGGCCTAACTACGGCTACACTAGAAGGACAGTATTTGGTATCTGCGCTCTGCTGAAGCCAGTTACCTTC GGAAAAAGAGTTGGTAGCTCTTGATCCGGCAAACAAACCACCGCTGGTAGCGGTGGTTTTTTGTTTGCAAGCAGCAGATTACGCGCAGAAAAAAG GATCTCAAGAAGATCCTTTGATCTTTTCTACGGGGTCTGACGCTCAGTGGAACGAAAACTCACGTTAAGGGATTTTGGTCATGAGATTATCAAAAG GATCTTCACCTAGATCCTTTTAAATTAAAAATGAAGTTTTAAATCAATCTAAAGTATATATGAGTAAACTTGGTCTGACAGTTACCAATGCTTAATC AGTGAGGCACCTATCTCAGCGATCTGTCTATTTCGTTCATCCATAGTTGCCTGACTCCCCGTCGTGTAGATAACTACGATACGGGAGGGCTTACCAT CTGGCCCCAGTGCTGCAATGATACCGCGAGACCCACGCTCACCGGCTCCAGATTTATCAGCAATAAACCAGCCAGCCGGAAGGGCCGAGCGCAGAAG TGGTCCTGCAACTTTATCCGCCTCCATCCAGTCTATTAATTGTTGCCGGGAAGCTAGAGTAAGTAGTTCGCCAGTTAATAGTTTGCGCAACGTTGTT GCCATTGCTACAGGCATCGTGGTGTCACGCTCGTCGTTTGGTATGGCTTCATTCAGCTCCGGTTCCCAACGATCAAGGCGAGTTACATGATCCCCCA TGTTGTGCAAAAAAGCGGTTAGCTCCTTCGGTCCTCCGATCGTTGTCAGAAGTAAGTTGGCCGCAGTGTTATCACTCATGGTTATGGCAGCACTGCA TAATTCTCTTACTGTCATGCCATCCGTAAGATGCTTTTCTGTGACTGGTGAGTACTCAACCAAGTCATTCTGAGAATAGTGTATGCGGCGACCGAGT TGCTCTTGCCCGGCGTCAATACGGGATAATACCGCGCCACATAGCAGAACTTTAAAAGTGCTCATCATTGGAAAACGTTCTTCGGGGCGAAAACTCT CAAGGATCTTACCGCTGTTGAGATCCAGTTCGATGTAACCCACTCGTGCACCCAACTGATCTTCAGCATCTTTTACTTTCACCAGCGTTTCTGGGTG AGCAAAAACAGGAAGGCAAAATGCCGCAAAAAAGGGAATAAGGGCGACACGGAAATGTTGAATACTCATACTCTTCCTTTTTCAATATTATTGAAGC ATTTATCAGGGTTATTGTCTCATGAGCGGATACATATTTGAATGTATTTAGAAAAATAAACAAATAGGGGTTCCGCGCACATTTCCCCGAAAAGTGC CACCTGACGTCGACGGATCGGGAGATCTCCCGATCCCCTATGGTCGACTCTCAGTACAATCTGCTCTGATGCCGCATAGTTAAGCCAGTATCTGCTC CCTGCTTGTGTGTTGGAGGTCGCTGAGTAGTGCGCGAGCAAAATTTAAGCTACAACAAGGCAAGGCTTGACCGACAATTGCATGAAGAATCTGCTTA GGGTTAGGCGTTTTGCGCTGCTTCGCGATGTACGGGCCAGATATACGCGTTGACATTGATTATTGACTAGTTATTAATAGTAATCAATTACGGGGTC ATTAGTTCATAGCCCATATATGGAGTTCCGCGTTACATAACTTACGGTAAATGGCCCGCCTGGCTGACCGCCCAACGACCCCCGCCCATTGACGTCA ATAATGACGTATGTTCCCATAGTAACGCCAATAGGGACTTTCCATTGACGTCAATGGGTGGACTATTTACGGTAAACTGCCCACTTGGCAGTACATC AAGTGTATCATATGCCAAGTACGCCCCCTATTGACGTCAATGACGGTAAATGGCCCGCCTGGCATTATGCCCAGTACATGACCTTATGGGACTTTCC TACTTGGCAGTACATCTACGTATTAGTCATCGCTATTACCATGGTGATGCGGTTTTGGCAGTACATCAATGGGCGTGGATAGCGGTTTGACTCACGG GGATTTCCAAGTCTCCACCCCATTGACGTCAATGGGAGTTTGTTTTGGCACCAAAATCAACGGGACTTTCCAAAATGTCGTAACAACTCCGCCCCAT TGACGCAAATGGGCGGTAGGCGTGTACGGTGGGAGGTCTATATAAGCAGAGCTCTCTGGCTAACTAGAGAACCCACTGCTTACTGGCTTATCGAAAT
```

Complete Protein and Coding Sequence for Each TALE Used in Gene Activation Studies:

To regenerate the sequence of each expression construct, replace the underlined region of the above construct with each CDS shown below.

Note that the NT-L +95 protein includes a nuclear localization sequence (NLS) from SV40, while nuclear import for NT-L +278 relies on endogenous localization sequences present in the TALE C-terminal flanking region[3].

```
>NT-L +278 VP16
                                                                                        (SEQ ID NO: 304)
MVDLRTLGYSQQQQEKIKPKVRSTVAQHHEALVGHGFTHAHIVALSQHPAALGTVAVKYQDMIAALPEATHEAIVGVGKQWSGARALEALLTVAGEL

RGPPLQLDTGQLLKIAKRGGVTAVEAVHAWRNALTGAPLNLTPEQVVAIASNNGGKQALETVQRLLPVLCQAHGLTPQQVVAIASNNGGKQALETVQ

RLLPVLCQAHGLTPQQVVAIASNIGGKQALETVQRLLPVLCQAHGLTPEQVVAIASNNGGKQALETVQRLLPVLCQAHGLTPEQVVAIASHDGGKQA

LETVQALLPVLCQAHGLTPEQVVAIASHDGGKQALETVQALLPVLCQAHGLTPEQVVAIASNIGGKQALETVQALLPVLCQAHGLTPEQVVAIASNG

GGKQALETVQRLLPVLCQAHGLTPEQVVAIASHDGGKQALETVQRLLPVLCQAHGLTPQQVVAIASNGGGKQALETVQRLLPVLCQAHGLTPEQVVA

IASNNGGKQALETVQALLPVLCQAHGLTPEQVVAIASNKGGKQALETVQRLLPVLCQAHGLTPEQVVAIASHDGGKQALETVQRLLPVLCQAHGLTP

EQVVAIASHDGGKQALETVQRLLPVLCQAHGLTPEQVVAIASNNGGKQALETVQRLLPVLCQAHGLTPQQVVAIASNKGGRPALETVQRLLPVLCQA

HGLTPEQVVAIASNNGGKQALETVQRLLPVLCQAHGLTPQQVVAIASNGGGRPALESIVAQLSRPDPALAALTNDHLVALACLGGRPALDAVKKGLP

HAPALIKRTNRRIPERTSHRVADHAQVVRVLGFFQCHSHPAQAFDDAMTQFGMSRHGLLQLFRAVGVTELEARSGTLPPASQRWDRILQASGMKRAK

PSPTSTQTPDQASLHAFADSLERDLDAPSPTHEGDQRRASSRKRSRSDRAVTGPSAQQSFEVRAPEQRDALHLPLSWRVKRPRTSIGGGLPDPGTPT

AADLAASSTVMREQDEDPFAGAADDFPAFNEEELAWLMELLPQDRGRAPPTDVSLGDELHLDGEDVAMAHADALDDFDLDMLGDGDSPGPGFTPHDS

APYGALDMADFEFEQMFTDALGIDEYGGGRDYKDDDDK
```

>NT-L +278 VP16

(SEQ ID NO: 305)

ATGGTGGATCTACGCACGCTCGGCTACAGCCAGCAGCAACAGGAGAAGATCAAACCGAAGGTTCGTTCGACAGTGGCGCAGCACCACGAGGCACTGG
TCGGCCATGGGTTTACACACGCGCACATCGTTGCGCTCAGCCAACACCCGGCAGCGTTAGGGACCGTCGCTGTCAAGTATCAGGACATGATCGCAGC
GTTGCCAGAGGCGACACACGAAGCGATCGTTGGCGTCGGCAAACAGTGGTCCGGCGCACGCGCCCTGGAGGCCTTGCTCACGGTGGCGGGAGAGTTG
AGAGGTCCACCGTTACAGTTGGACACAGGCCAACTTCTCAAGATTGCAAAACGTGGCGGCGTGACCGCAGTGGAGGCAGTGCATGCATGGCGCAATG
CACTGACGGGGCCCCCCTGAACCTTACTCCCGAACAAGTAGTAGCGATAGCCAGTAATAACGGAGGTAAACAAGCCTTGGAGACGGTCCAAAGGTT
GCTCCCGGTCTTGTGTCAGGCACATGGGCTGACGCCTCAACAGGTCGTCGCGATAGCGTCTAATAATGGAGGAAAGCAAGCTCTGGAAACCGTCCAG
CGACTCCTTCCGGTTCTGTGCCAGGCTCATGGTCTGACTCCGCAGCAAGTCGTTGCTATAGCGTCCAACATCGGAGGCAAACAGGCCCTGGAGACCG
TGCAGCGGTTGTTGCCTGTGCTTTGCCAAGCCCACGGGCTTACGCCTGAGCAAGTGGTGGCGATTGCCAGTAACAACGGCGGCAAACAAGCCCTTGA
GACTGTGCAGAGGCTCTTGCCGGTACTCTGCCAAGCACACGGCTTGACCCCCGAGCAGGTTGTAGCCATAGCTAGTCACGACGGGGGTAAGCAAGCG
TTGGAAACGGTGCAAGCACTTCTCCCCGTTCTCTGTCAAGCGCATGGACTTACCCCGGAACAGGTGGTCGCCATTGCAAGCCATGATGGAGGAAAGC
AGGCGCTCGAAACAGTCCAGGCACTTTTGCCCGTACTTTGTCAAGCTCACGGTCTCACCCCGGAACAGGTGGTAGCCATTGCATCTAACATCGGAGG
TAAGCAAGCATTGGAAACGGTTCAGGCCCTGTTGCCTGTACTTTGCCAGGCGCACGGTCTGACACCTGAGCAGGTTGTCGCCATCGCTAGCAACGGA
GGTGGGAAACAGGCACTTGAAACTGTGCAGAGGCTTCTGCCGGTGCTGTGCCAAGCGCATGGCCTTACACCCGAGCAAGTAGTGGCTATTGCGAGTC
ATGATGGAGGCAAGCAAGCGCTGGAGACTGTCCAACGACTTCTTCCGGTCTTGTGTCAGGCACATGGATTGACCCCTCAACAAGTCGTGGCGATAGC
TAGCAACGGCGGTGGAAAACAGGCCCTCGAAACCGTCCAGCGACTGCTCCCCGTACTGTGTCAAGCCCATGGACTTACCCCAGAACAAGTTGTGGCG
ATTGCCTCTAACAATGGTGGGAAGCAAGCTCTTGAGACGGTGCAGGCGTTGTTGCCCGTGCTTTGTCAAGCTCACGGGCTCACGCCAGAGCAAGTGG
TCGCTATCGCGAGTAATAAAGGGGGCAAACAAGCCTTGGAGACAGTGCAAAGGCTCCTGCCAGTGCTCTGCCAGGCTCATGGTTTGACACCCGAACA
GGTAGTTGCAATAGCGAGTCATGATGGCGAAAGCAAGCTCTTGAAACTGTGCAGCGGCTGTTGCCTGTACTGTGTCAAGCCCACGGGCTGACACCG
GAACAAGTTGTAGCGATCGCTAGCCACGATGGCGGGAAACAAGCTCTGGAAACGGTACAGAGACTCCTCCCAGTGCTTTGTCAGGCACACGGCCTCA
CGCCAGAGCAGGTTGTCGCCATCGCGTCAAACAATGGTGGAAAGCAGGCCCTGGAGACAGTCCAACGGTTGCTGCCGGTCCTTTGCCAGGCTCACGG
GTTGACCCCCCAGCAGGTCGTGGCCATTGCCTCAAACAAGGGCGGTAGGCCAGCATTGGAGACGGTGCAGAGGCTTCTGCCTGTGCTCTGCCAAGCG
CATGGACTCACCCCCGAGCAAGTGGTTGCTATCGCAAGTAACAACGGAGGGAAACAAGCGCTCGAAACCGTGCAAAGGTTGCTCCCCGTTCTCTGTC
AGGCGCACGGTCTTACGCCACAACAGGTGGTGGCGATTGCATCTAATGGAGGCGGACGCCCTGCCTTGGAGAGCATTGTGGCCCAGCTGTCCAGGCC
GGACCCTGCCCTGGCCGCGTTAACCAACGACCACCTCGTCGCCTTGGCCTGCCTCGGCGACGTCCTGCGCTGGATGCAGTGAAAAAGGGATTGCCG
CACGCGCCGGCCTTGATCAAAAGAACCAATCGCCGTATTCCCGAACGCACATCCCATCGCGTTGCCGACCACGCGCAAGTGGTTCGCGTGCTGGGTT
TTTTCCAGTGCCACTCCCACCCAGCGCAAGCATTTGATGACGCCATGACGCAGTTCGGGATGAGCAGGCACGGGTTGTTACAGCTCTTTCGCAGAGT
GGGCGTCACCGAACTCGAAGCCCGCAGTGGAACGCTCCCCCAGCCTCGCAGCGTTGGGACCGTATCCTCCAGGCATCAGGGATGAAAAGGGCCAAA
CCGTCCCTACTTCAACTCAAACGCCGGACCAGGCGTCTTTGCATGCATTCGCCGATTCGCTGGAGCGTGACCTTGATGCGCCCAGCCCAACGCACG
AGGGAGATCAGAGGCGGGCAAGCAGCCGTAAACGGTCCCGATCGGATCGTGCTGTCACCGGTCCCTCCGCACAGCAATCGTTCGAGGTGCGCGCTCC
CGAACAGCGCGATGCGCTGCATTTGCCCCTCAGTTGGAGGGTAAAACGCCCGCGTACCAGTATCGGGGGCGGCCTCCCGGATCCTGGTACGCCCACG
GCTGCCGACCTGGCAGCGTCCAGCACCGTGATGCGGGAACAAGATGAGGACCCCTTCGCAGGGGCAGCGGATGATTTCCCGGCATTCAACGAAGAGG
AGCTCGCATGGTTGATGGAGCTATTGCCTCAGGACCGCGGCCGCGCCCCCCGACCGATGTCAGCCTGGGGACGAGCTCCACTTAGACGGCGAGGA
CGTGGCGATGGCGCATGCCGACGCGCTAGACGATTTCGATCTGGACATGTTGGGGGACGGGGATTCCCCGGGTCCGGGATTTACCCCCCACGACTCC
GCCCCCTACGGCGCTCTGGATATGGCCGACTTCGAGTTTGAGCAGATGTTTACCGATGCCCTTGGAATTGACGAGTACGGTGGCGGCCGCGACTACA
AGGACGACGATGACAAG

>NT-L +95 VP16

(SEQ ID NO: 306)

MAPKKKRKVGIDGVPAAVDLRTLGYSQQQQEKIKPKVRSTVAQHHEALVGHGFTHAHIVALSQHPAALGTVAVKYQDMIAALPEATHEAIVGVGKQW
SGARALEALLTVAGELRGPPLQLDTGOLLKIAKRGGVTAVEAVHAWRNALTGAPLNLTPEQVVAIASNNGGKQALETVQRLLPVLCQAHGLTPQQVV
AIASNNGGKQALETVQRLLPVLCQAHGLTPQQVVAIASNIGGKQALETVQRLLPVLCQAHGLTPEQVVAIASNNGGKQALETVQRLLPVLCQAHGLT
PEQVVAIASHDGGKQALETVQALLPVLCQAHGLTPEQVVAIASHDGGKQALETVQALLPVLCQAHGLTPEQVVAIASNIGGKQALETVQALLPVLCQ

-continued

AHGLTPEQVVAIASNGGGKQALETVQRLLPVLCQAHGLTPEQVVAIASHDGGKQALETVQRLLPVLCQAHGLTPQQVVAIASNGGGKQALETVQRLL
PVLCQAHGLTPEQVVAIASNNGGKQALETVQALLPVLCQAHGLTPEQVVAIASNKGGKQALETVQRLLPVLCQAHGLTPEQVVAIASHDGGKQALET
VQRLLPVLCQAHGLTPEQVVAIASHDGGKQALETVQRLLPVLCQAHGLTPEQVVAIASNNGGKQALETVQRLLPVLCQAHGLTPQQVVAIASNKGGR
PALETVQRLLPVLCQAHGLTPEQVVAIASNNGGKQALETVQRLLPVLCQAHGLTPQQVVAIASNGGGRPALESIVAQLSRPDPALAALTNDHLVALA
CLGGRPALDAVKKGLPHAPALIKRTNRRIPERTSHRVADHAQVVRVLGFFQCHSHPAQAFDDAMTQFGMSGSRGRAPPTDVSLGDELHLDGEDVAMA
HADALDDFDLDMLGDGDSPGPGFTPHDSAPYGALDMADFEFEQMFTDALGIDEYGGGRDYKDDDDK

>NT-L +95 VP16 (SEQ ID NO: 307)
ATGGCCCCCAAGAAGAAGAGGAAGGTGGGAATCGATGGGGTACCCGCCGCTGTGGATCTACGCACGCTCGGCTACAGCCAGCAGCAACAGGAGAAGA
TCAAACCGAAGGTTCGTTCGACAGTGGCGCAGCACCACGAGGCACTGGTCGGCCATGGGTTTACACACGCGCACATCGTTGCGCTCAGCCAACACCC
GGCAGCGTTAGGGACCGTCGCTGTCAAGTATCAGGACATGATCGCAGCGTTGCCAGAGGCGACACACGAAGCGATCGTTGGCGTCGGCAAACAGTGG
TCCGGCGCACGCGCCCTGGAGGCCTTGCTCACGGTGGCGGGAGAGTTGAGAGGTCCACCGTTACAGTTGGACACAGGCCAACTTCTCAAGATTGCAA
AACGTGGCGGCGTGACCGCAGTGGAGGCAGTGCATGCATGGCGCAATGCACTGACGGGGGCCCCCCTGAACCTTACTCCCGAACAAGTAGTAGCGAT
AGCCAGTAATAACGGAGGTAAACAAGCCTTGGAGACGGTCCAAAGGTTGCTCCCGGTCTTGTGTCAGGCACATGGGCTGACGCCTCAACAGGTCGTC
GCGATAGCGTCTAATAATGGAGGAAAGCAAGCTCTGGAAACCGTCCAGCGACTCCTTCCGGTTCTGTGCCAGGCTCATGGTCTGACTCCGCAGCAAG
TCGTTGCTATAGCGTCCAACATCGGAGGCAAACAGGCCCTGGAGACCGTGCAGCGGTTGTTGCCTGTGCTTTGCCAAGCCCACGGGCTTACGCCTGA
GCAAGTGGTGGCGATTGCCAGTAACAACGGCGGCAAACAAGCCCTTGAGACTGTGCAGAGGCTCTTGCCGGTACTCTGCCAAGCACACGGCTTGACC
CCCGAGCAGGTTGTAGCCATAGCTAGTCACGACGGGGGTAAGCAAGCGTTGGAAACGGTGCAAGCACTTCTCCCCGTTCTCTGTCAAGCGCATGGAC
TTACCCCGGAACAGGTGGTCGCCATTGCAAGCCATGATGGAGGAAAGCAGGCGCTCGAAACAGTCCAGGCACTTTTGCCCGTACTTTGTCAAGCTCA
CGGTCTCACCCCGGAACAGGTGGTAGCCATTGCATCTAACATCGGAGGTAAGCAAGCATTGGAAACGGTTCAGGCCCTGTTGCCTGTACTTTGCCAG
GCGCACGGTCTGACACCTGAGCAGGTTGTCGCCATCGCTAGCAACGGAGGTGGGAAACAGGCACTTGAAACTGTGCAGAGGCTTCTGCCGGTGCTGT
GCCAAGCGCATGGCCTTACACCCGAGCAAGTAGTGGCTATTGCGAGTCATGATGGAGGCAAGCAAGCGCTGGAGACTGTCCAACGACTTCTTCCGGT
CTTGTGTCAGGCACATGGATTGACCCCTCAACAAGTCGTGGCGATAGCTAGCAACGGCGGTGGAAAACAGGCCCTCGAAACCGTCCAGCGACTGCTC
CCCGTACTGTGTCAAGCCCATGGACTTACCCCAGAACAAGTTGTGGCGATTGCCTCTAACAATGGTGGGAAGCAAGCTCTTGAGACGGTGCAGGCGT
TGTTGCCCGTGCTTTGTCAAGCTCACGGGCTCACGCCAGAGCAAGTGGTCGCTATCGCGAGTAATAAAGGGGGCAAACAAGCCTTGGAGACAGTGCA
AAGGCTCCTGCCAGTGCTCTGCCAGGCTCATGGTTTGACACCCGAACAGGTAGTTGCAATAGCGAGTCATGATGGCGGAAAGCAAGCTCTTGAAACT
GTGCAGCGGCTGTTGCCTGTACTGTGTCAAGCCCACGGGCTGACACCGGAACAAGTTGTAGCGATCGCTAGCCACGATGGCGGGAAACAAGCTCTGG
AAACGGTACAGAGACTCCTCCCAGTGCTTTGTCAGGCACACGGCCTCACGCCAGAGCAGGTTGTCGCCATCGCGTCAAACAATGGTGGAAAGCAGGC
CCTGGAGACAGTCCAACGGTTGCTGCCGGTCCTTTGCCAGGCTCACGGGTTGACCCCCCAGCAGGTCGTGGCCATTGCCTCAAACAAGGGCGGTAGG
CCAGCATTGGAGACGGTGCAGAGGCTTCTGCCTGTGCTCTGCCAAGCGCATGGACTCACCCCCGAGCAAGTGGTTGCTATCGCAAGTAACAACGGAG
GGAAACAAGCGCTCGAAACCGTGCAAAGGTTGCTCCCCGTTCTCTGTCAGGCGCACGGTCTTACGCCACAACAGGTGGTGGCGATTGCATCTAATGG
AGGCGGACGCCCTGCCTTGGAGAGCATTGTGGCCCAGCTGTCCAGGCCGGACCCTGCCCTGGCCGCGTTAACCAACGACCACCTCGTCGCCTTGGCC
TGCCTCGGCGGACGTCCTGCGCTGGATGCAGTGAAAAAGGGATTGCCGCACGCGCCGGCCTTGATCAAAAGAACCAATCGCCGTATTCCCGAACGCA
CATCCCATCGCGTTGCCGACCACGCGCAAGTGGTTCGCGTGCTGGGTTTTTTCCAGTGCCACTCCCACCCAGCGCAAGCATTTGATGACGCCATGAC
GCAGTTCGGGATGAGCGGATCCCGCGGCCGCGCCCCCCGACCGATGTCAGCCTGGGGGACGAGCTCCACTTAGACGGCGAGGACGTGGCGATGGCG
CATGCCGACGCGCTAGACGATTTCGATCTGGACATGTTGGGGGACGGGGATTCCCCGGGTCCGGGATTTACCCCCCACGACTCCGCCCCCTACGGCG
CTCTGGATATGGCCGACTTCGAGTTTGAGCAGATGTTTACCGATGCCCTTGGAATTGACGAGTACGGTGGCGGCCGCGACTACAAGGACGACGATGA
CAAG

>TALE13 +278 VP16 (SEQ ID NO: 308)
MAPKKKRKVGIDGVPAAVDLRTLGYSQQQQEKIKPKVRSTVAQHHEALVGHGFTHAHIVALSQHPAALGTVAVKYQDMIAALPEATHEAIVGVGKQW
SGARALEALLTVAGELRGPPLQLDTGQLLKIAKRGGVTAVEAVHAWRNALTGAPLNLTPEQVVAIASNIGGKQALETVQRLLPVLCQAHGLTPEQVV

-continued

AIASNGGKQALETVQRLLPVLCQAHGLTPEQVVAIASNIGGKQALETVQRLLPVLCQAHGLTPEQVVAIASNIGGKQALETVQRLLPVLCQAHGLTP

AQVVAIASNIGGKQALETVQRLLPVLRQAHGLTPEQVVAIASNGGKQALETVQRLLPVLCQAHGLTPAQVVAIASNIGGKQALETVQRLLPVLCQAH

GLTPEQVVAIASHDGGKQALETVQRLLPVLCQAHGLTPEQVVAIASHDGGKQALETVQRLLPVLCQAHGLTPDQVVAIASNGGGKQALETVQRLLPV

LCQAHGLTPDQVVAIASNGGGKQALETVQRLLPVLCQAHGLTPEQVVAIASHDGGKQALETVQRLLPVLCQAHGLTPEQVVAIASNGGGRPALESIV

AQLSRPDPALAALTNDHLVALACLGGRPALDAVKKGLPHAPALIKRTNRRIPERTSHRVADHAQVVRVLGFFQCHSHPAQAFDDAMTQFGMSRHGLL

QLFRRVGVTELEARSGTLPPASQRWDRILQASGMKRAKPSPTSTQTPDQASLHAFADSLERDLDAPSPTHEGDQRRASSRKRSRSDRAVTGPSAQQS

FEVRAPEQRDALHLPLSWRVKRPRTSIGGGLPDPGTPTAADLAASSTVMREQDEDPFAGAADDFPAFNEEELAWLMELLPQDRGRAPPTDVSLGDEL

HLDGEDVAMAHADALDDFDLDMLGDGDSPGPGFTPHDSAPYGALDMADFEFEQMFTDALGIDEYGGGRDYKDDDDK

>TALE13 +278 VP16

(SEQ ID NO: 309)

ATGGCCCCCAAGAAGAAGAGGAAGGTGGGAATCGATGGGGTACCCGCCGCTGTGGATCTACGCACGCTCGGCTACAGCCAGCAGCAACAGGAGAAGA

TCAAACCGAAGGTTCGTTCGACAGTGGCGCAGCACCACGAGGCACTGGTCGGCCATGGGTTTACACACGCGCACATCGTTGCGCTCAGCCAACACCC

GGCAGCGTTAGGGACCGTCGCTGTCAAGTATCAGGACATGATCGCAGCGTTGCCAGAGGCGACACACGAAGCGATCGTTGGCGTCGGCAAACAGTGG

TCCGGCGCACGCGCCCTGGAGGCCTTGCTCACGGTGGCGGGAGAGTTGAGAGGTCCACCGTTACAGTTGGACACAGGCCAACTTCTCAAGATTGCAA

AACGTGGCGGCGTGACCGCAGTGGAGGCAGTGCATGCATGGCGCAATGCACTGACGGGGGCCCCCCTGAACCTGACCCCGGAGCAGGTGGTGGCCAT

CGCCAGCAATATTGGTGGCAAGCAGGCGCTGGAGACGGTGCAGCGGCTGTTGCCGGTGCTGTGCCAGGCCCATGGCCTGACCCCGGAGCAGGTGGTG

GCCATCGCCAGCAATGGCGGCAAGCAGGCGCTGGAGACGGTGCAGCGGCTGTTGCCGGTGCTGTGCCAGGCCCATGGCCTGACCCCGGAGCAGGTGG

TGGCCATCGCCAGCAATATTGGTGGCAAGCAGGCGCTGGAGACGGTGCAGCGGCTGTTGCCGGTGCTGTGCCAGGCCCATGGCCTGACCCCGGAGCA

GGTGGTGGCCATCGCCAGCAATATTGGTGGCAAGCAGGCGCTGGAGACGGTGCAGCGGCTGTTGCCGGTGCTGTGCCAGGCCCATGGCCTGACCCCG

GCACAGGTGGTGGCCATCGCCAGCAATATTGGCGGCAAGCAGGCGCTGGAGACGGTGCAGCGGCTGTTGCCGGTGCTGCGCCAGGCCCATGGCCTGA

CCCCGGAGCAGGTCGTGGCCATCGCCAGCAATGGCGGCAAGCAGGCGCTGGAGACGGTGCAGCGGCTGTTGCCGGTGCTGTGCCAGGCCCATGGCCT

GACCCCGGCACAGGTGGTGGCCATCGCCAGCAATATTGGCGGCAAGCAGGCGCTGGAGACGGTGCAGCGGCTGTTGCCGGTGCTGTGCCAGGCCCAT

GGCCTGACCCCGGAGCAGGTCGTGGCCATCGCCAGCCACGATGGCGGCAAGCAGGCGCTGGAGACGGTGCAGCGGCTGTTGCCGGTGCTGTGCCAGG

CCCATGGCCTGACCCCGGAGCAGGTGGTGGCCATCGCCAGCCACGATGGCGGCAAGCAGGCGCTGGAGACGGTGCAGCGGCTGTTGCCGGTGCTGTG

CCAGGCCCATGGCCTGACCCCGGACCAGGTGGTGGCCATCGCCAGCAATGGCGGTGGCAAGCAGGCGCTGGAGACGGTGCAGCGGCTGTTGCCGGTG

CTGTGCCAGGCCCATGGCCTGACCCCGGACCAGGTGGTGGCCATCGCCAGCAATGGCGGTGGCAAGCAGGCGCTGGAGACGGTGCAGCGGCTGTTGC

CGGTGCTGTGCCAGGCCCATGGCCTGACCCCGGAGCAGGTGGTGGCCATCGCCAGCCACGATGGCGGCAAGCAGGCGCTGGAGACGGTGCAGCGGCT

GTTGCCGGTGCTGTGCCAGGCCCATGGCCTGACCCCGGAGCAGGTGGTGGCCATCGCCAGCAATGGCGGCGGCAGGCCGGCGCTGGAGAGCATTGTT

GCCCAGTTATCTCGCCCTGATCCGGCGTTGGCCGCGTTAACCAACGACCACCTCGTCGCCTTGGCCTGCCTCGGCGGACGTCCTGCGCTGGATGCAG

TGAAAAAGGGATTGCCGCACGCGCCGGCCTTGATCAAAAGAACCAATCGCCGTATTCCCGAACGCACATCCCATCGCGTTGCCGACCACGCGCAAGT

GGTTCGCGTGCTGGGTTTTTTCCAGTGCCACTCCCACCCAGCGCAAGCATTTGATGACGCCATGACGCAGTTCGGGATGAGCAGGCACGGGTTGTTA

CAGCTCTTTCGCAGAGTGGGCGTCACCGAACTCGAAGCCCGCAGTGGAACGCTCCCCCCAGCCTCGCAGCGTTGGGACCGTATCCTCCAGGCATCAG

GGATGAAAAGGGCCAAACCGTCCCCTACTTCAACTCAAACGCCGGACCAGGCGTCTTTGCATGCATTCGCCGATTCGCTGGAGCGTGACCTTGATGC

GCCCAGCCCAACGCACGAGGGAGATCAGAGGCGGCAAGCAGCCGTAAACGGTCCCGATCGGATCGTGCTGTCACCGGTCCCTCCGCACAGCAATCG

TTCGAGGTGCGCGCTCCCGAACAGCGCGATGCGCTGCATTTGCCCCTCAGTTGGAGGGTAAAACGCCCGCGTACCAGTATCGGGGGCGGCCTCCCGG

ATCCTGGTACGCCCACGGCTGCCGACCTGGCAGCGTCCAGCACCGTGATGCGGGAACAAGATGAGGACCCCTTCGCAGGGGCAGCGGATGATTTCCC

GGCATTCAACGAAGAGGAGCTCGCATGGTTGATGGAGCTATTGCCTCAGGACCGCGGCCGCGCCCCCCCGACCGATGTCAGCCTGGGGGACGAGCTC

CACTTAGACGGCGAGGACGTGGCGATGGCGCATGCCGACGCGCTAGACGATTTCGATCTGGACATGTTGGGGGACGGGGATTCCCCGGGTCCGGGAT

TTACCCCCCACGACTCCGCCCCCTACGGCGCTCTGGATATGGCCGACTTCGAGTTTGAGCAGATGTTTACCGATGCCCTTGGAATTGACGAGTACGG

TGGCGGCCGCGACTACAAGGACGACGATGACAAG

>TALE13 +133 VP16

(SEQ ID NO: 310)

MVDLRTLGYSQQQQEKIKPKVRSTVAQHHEALVGHGFTHAHIVALSQHPAALGTVAVKYQDMIAALPEATHEAIVGVGKQWSGARALEALLTVAGEL
RGPPLQLDTGQLLKIAKRGGVTAVEAVHAWRNALTGAPLNLTPEQVVAIASNIGGKQALETVQRLLPVLCQAHGLTPEQVVAIASNGGKQALETVQR
LLPVLCQAHGLTPEQVVAIASNIGGKQALETVQRLLPVLCQAHGLTPEQVVAIASNIGGKQALETVQRLLPVLCQAHGLTPAQVVAIASNIGGKQAL
ETVQRLLPVLRQAHGLTPEQVVAIASNGGKQALETVQRLLPVLCQAHGLTPAQVVAIASNIGGKQALETVQRLLPVLCQAHGLTPEQVVAIASHDGG
KQALETVQRLLPVLCQAHGLTPEQVVAIASHDGGKQALETVQRLLPVLCQAHGLTPDQVVAIASNGGGKQALETVQRLLPVLCQAHGLTPDQVVAIA
SNGGGKQALETVQRLLPVLCQAHGLTPEQVVAIASHDGGKQALETVQRLLPVLCQAHGLTPEQVVAIASNGGGRPALESIVAQLSRPDPALAALTND
HLVALACLGGRPALDAVKKGLPHAPALIKRTNRRIPERTSHRVADHAQVRVLGFFQCHSHPAQAFDDAMTQFGMSRHGLLQLFRRVGVTELEARSG
TLPPASQRWDRILQASGGSGHRGRAPPTDVSLGDELHLDGEDVAMAHADALDDFDLDMLGDGDSPGPGFTPHDSAPYGALDMADFEFEQMFTDALGI
DEYGGGRDYKDDDDK

>TALE13 +133 VP16

(SEQ ID NO: 311)

ATGGTGGATCTACGCACGCTCGGCTACAGCCAGCAGCAACAGGAGAAGATCAAACCGAAGGTTCGTTCGACAGTGGCGCAGCACCACGAGGCACTGG
TCGGCCATGGGTTTACACACGCGCACATCGTTGCGCTCAGCCAACACCCGGCAGCGTTAGGGACCGTCGCTGTCAAGTATCAGGACATGATCGCAGC
GTTGCCAGAGGCGACACACGAAGCGATCGTTGGCGTCGGCAAACAGTGGTCCGGCGCACGCGCCCTGGAGGCCTTGCTCACGGTGGCGGGAGAGTTG
AGAGGTCCACCGTTACAGTTGGACACAGGCCAACTTCTCAAGATTGCAAAACGTGGCGGCGTGACCGCAGTGGAGGCAGTGCATGCATGGCGCAATG
CACTGACGGGTGCCCCCCTGAACCTGACCCCGGAGCAGGTGGTGGCCATCGCCAGCAATATTGGTGGCAAGCAGGCGCTGGAGACGGTGCAGCGGCT
GTTGCCGGTGCTGTGCCAGGCCCATGGCCTGACCCCGGAGCAGGTGGTGGCCATCGCCAGCAATGGCGGCAAGCAGGCGCTGGAGACGGTGCAGCGG
CTGTTGCCGGTGCTGTGCCAGGCCCATGGCCTGACCCCGGAGCAGGTGGTGGCCATCGCCAGCAATATTGGTGGCAAGCAGGCGCTGGAGACGGTGC
AGCGGCTGTTGCCGGTGCTGTGCCAGGCCCATGGCCTGACCCCGGAGCAGGTGGTGGCCATCGCCAGCAATATTGGTGGCAAGCAGGCGCTGGAGAC
GGTGCAGCGGCTGTTGCCGGTGCTGTGCCAGGCCCATGGCCTGACCCCGGCACAGGTGGTGGCCATCGCCAGCAATATTGGCGGCAAGCAGGCGCTG
GAGACGGTGCAGCGGCTGTTGCCGGTGCTGCGCCAGGCCCATGGCCTGACCCCGGAGCAGGTCGTGGCCATCGCCAGCAATGGCGGCAAGCAGGCGC
TGGAGACGGTGCAGCGGCTGTTGCCGGTGCTGTGCCAGGCCCATGGCCTGACCCCGGCACAGGTGGTGGCCATCGCCAGCAATATTGGCGGCAAGCA
GGCGCTGGAGACGGTGCAGCGGCTGTTGCCGGTGCTGTGCCAGGCCCATGGCCTGACCCCGGAGCAGGTCGTGGCCATCGCCAGCCACGATGGCGGC
AAGCAGGCGCTGGAGACGGTGCAGCGGCTGTTGCCGGTGCTGTGCCAGGCCCATGGCCTGACCCCGGAGCAGGTGGTGGCCATCGCCAGCCACGATG
GCGGCAAGCAGGCGCTGGAGACGGTGCAGCGGCTGTTGCCGGTGCTGTGCCAGGCCCATGGCCTGACCCCGGACCAGGTGGTGGCCATCGCCAGCAA
TGGCGGTGGCAAGCAGGCGCTGGAGACGGTGCAGCGGCTGTTGCCGGTGCTGTGCCAGGCCCATGGCCTGACCCCGGACCAGGTGGTGGCCATCGCC
AGCAATGGCGGTGGCAAGCAGGCGCTGGAGACGGTGCAGCGGCTGTTGCCGGTGCTGTGCCAGGCCCATGGCCTGACCCCGGAGCAGGTGGTGGCCA
TCGCCAGCCACGATGGCGGCAAGCAGGCGCTGGAGACGGTGCAGCGGCTGTTGCCGGTGCTGTGCCAGGCCCATGGCCTGACCCCGGAGCAGGTGGT
GGCCATCGCCAGCAATGGCGGCGGCAGGCCGGCGCTGGAGAGCATTGTTGCCCAGTTATCTCGCCCTGATCCGGCGTTGGCCGCGTTGACCAACGAC
CACCTCGTCGCCTTGGCCTGCCTCGGCGGACGTCCTGCGCTGGATGCAGTGAAAAAGGGATTGCCGCACGCGCCGGCCTTGATCAAAAGAACCAATC
GCCGTATTCCCGAACGCACATCCCATCGCGTTGCCGACCACGCGCAAGTGGTTCGCGTGCTGGGTTTTTTCCAGTGCCACTCCCACCCAGCGCAAGC
ATTTGATGACGCCATGACGCAGTTCGGGATGAGCAGGCACGGGTTGTTACAGCTCTTTCGCAGAGTGGGCGTCACCGAACTCGAAGCCCGCAGTGGA
ACGCTCCCCCCAGCCTCGCAGCGTTGGGACCGTATCCTCCAGGCATCGGGGGATCCGGCCACCGCGGCCGCGCCCCCCGACCGATGTCAGCCTGG
GGGACGAGCTCCACTTAGACGGCGAGGACGTGGCGATGGCGCATGCCGACGCGCTAGACGATTTCGATCTGGACATGTTGGGGGACGGGGATTCCCC
GGGTCCGGGATTTACCCCCACGACTCCGCCCCTACGGCGCTCTGGATATGGCCGACTTCGAGTTTGAGCAGATGTTTACCGATGCCCTTGGAATT
GACGAGTACGGTGGCGGCCGCGACTACAAGGACGACGATGACAAG

>TALE13 +95 VP16

(SEQ ID NO: 312)

MVDLRTLGYSQQQQEKIKPKVRSTVAQHHEALVGHGFTHAHIVALSQHPAALGTVAVKYQDMIAALPEATHEAIVGVGKQWSGARALEALLTVAGEL
RGPPLQLDTGQLLKIAKRGGVTAVEAVHAWRNALTGAPLNLTPEQVVAIASNIGGKQALETVQRLLPVLCQAHGLTPEQVVAIASNGGKQALETVQR
LLPVLCQAHGLTPEQVVAIASNIGGKQALETVQRLLPVLCQAHGLTPEQVVAIASNIGGKQALETVQRLLPVLCQAHGLTPAQVVAIASNIGGKQAL
ETVQRLLPVLRQAHGLTPEQVVAIASNGGKQALETVQRLLPVLCQAHGLTPAQVVAIASNIGGKQALETVQRLLPVLCQAHGLTPEQVVAIASHDGG

KQALETVQRLLPVLCQAHGLTPEQVVAIASHDGGKQALETVQRLLPVLCQAHGLTPDQVVAIASNGGGKQALETVQRLLPVLCQAHGLTPDQVVAIA
SNGGGKQALETVQRLLPVLCQAHGLTPEQVVAIASHDGGKQALETVQRLLPVLCQAHGLTPEQVVAIASNGGGRPALESIVAQLSRPDPALAALTND
HLVALACLGGRPALDAVKKGLPHAPALIKRTNRRIPERTSHRVADHAQVVRVLGFFQCHSHPAQAFDDAMTQFGMSGSRGRAPPTDVSLGDELHLDG
EDVAMAHADALDDFDLDMLGDGDSPGPGFTPHDSAPYGALDMADFEFEQMFTDALGIDEYGGGRDYKDDDDK

>TALE13 +95 VP16 (SEQ ID NO: 313)
ATGGTGGATCTACGCACGCTCGGCTACAGCCAGCAGCAACAGGAGAAGATCAAACCGAAGGTTCGTTCGACAGTGGCGCAGCACCACGAGGCACTGG
TCGGCCATGGGTTTACACACGCGCACATCGTTGCGCTCAGCCAACACCCGGCAGCGTTAGGGACCGTCGCTGTCAAGTATCAGGACATGATCGCAGC
GTTGCCAGAGGCGACACACGAAGCGATCGTTGGCGTCGGCAAACAGTGGTCCGGCGCACGCGCCCTGGAGGCCTTGCTCACGGTGGCGGGAGAGTTG
AGAGGTCCACCGTTACAGTTGGACACAGGCCAACTTCTCAAGATTGCAAAACGTGGCGGCGTGACCGCAGTGGAGGCAGTGCATGCATGGCGCAATG
CACTGACGGGGCCCCCCTGAACCTGACCCCGGAGCAGGTGGTGGCCATCGCCAGCAATATTGGTGGCAAGCAGGCGCTGGAGACGGTGCAGCGGCT
GTTGCCGGTGCTGTGCCAGGCCCATGGCCTGACCCCGGAGCAGGTGGTGGCCATCGCCAGCAATGGCGGCAAGCAGGCGCTGGAGACGGTGCAGCGG
CTGTTGCCGGTGCTGTGCCAGGCCCATGGCCTGACCCCGGAGCAGGTGGTGGCCATCGCCAGCAATATTGGTGGCAAGCAGGCGCTGGAGACGGTGC
AGCGGCTGTTGCCGGTGCTGTGCCAGGCCCATGGCCTGACCCCGGAGCAGGTGGTGGCCATCGCCAGCAATATTGGTGGCAAGCAGGCGCTGGAGAC
GGTGCAGCGGCTGTTGCCGGTGCTGTGCCAGGCCCATGGCCTGACCCCGGCACAGGTGGTGGCCATCGCCAGCAATATTGGCGGCAAGCAGGCGCTG
GAGACGGTGCAGCGGCTGTTGCCGGTGCTGCGCCAGGCCCATGGCCTGACCCCGGAGCAGGTCGTGGCCATCGCCAGCAATGGCGGCAAGCAGGCGC
TGGAGACGGTGCAGCGGCTGTTGCCGGTGCTGTGCCAGGCCCATGGCCTGACCCCGGCACAGGTGGTGGCCATCGCCAGCAATATTGGCGGCAAGCA
GGCGCTGGAGACGGTGCAGCGGCTGTTGCCGGTGCTGTGCCAGGCCCATGGCCTGACCCCGGAGCAGGTCGTGGCCATCGCCAGCCACGATGGCGGC
AAGCAGGCGCTGGAGACGGTGCAGCGGCTGTTGCCGGTGCTGTGCCAGGCCCATGGCCTGACCCCGGAGCAGGTGGTGGCCATCGCCAGCCACGATG
GCGGCAAGCAGGCGCTGGAGACGGTGCAGCGGCTGTTGCCGGTGCTGTGCCAGGCCCATGGCCTGACCCCGGACCAGGTGGTGGCCATCGCCAGCAA
TGGCGGTGGCAAGCAGGCGCTGGAGACGGTGCAGCGGCTGTTGCCGGTGCTGTGCCAGGCCCATGGCCTGACCCCGGACCAGGTGGTGGCCATCGCC
AGCAATGGCGGTGGCAAGCAGGCGCTGGAGACGGTGCAGCGGCTGTTGCCGGTGCTGTGCCAGGCCCATGGCCTGACCCCGGAGCAGGTGGTGGCCA
TCGCCAGCCACGATGGCGGCAAGCAGGCGCTGGAGACGGTGCAGCGGCTGTTGCCGGTGCTGTGCCAGGCCCATGGCCTGACCCCGGAGCAGGTGGT
GGCCATCGCCAGCAATGGCGGCGGCAGGCCGGCGCTGGAGAGCATTGTTGCCCAGTTATCTCGCCCTGATCCGGCGTTGGCCGCGTTAACCAACGAC
CACCTCGTCGCCTTGGCCTGCCTCGGCGGACGTCCTGCGCTGGATGCAGTGAAAAAGGGATTGCCGCACGCGCCGGCCTTGATCAAAAGAACCAATC
GCCGTATTCCCGAACGCACATCCCATCGCGTTGCCGACCACGCGCAAGTGGTTCGCGTGCTGGGTTTTTTCCAGTGCCACTCCCACCCAGCGCAAGC
ATTTGATGACGCCATGACGCAGTTCGGGATGAGCGGATCCCGCGGCCGCGCCCCCCGACCGATGTCAGCCTGGGGGACGAGCTCCACTTAGACGGC
GAGGACGTGGCGATGGCGCATGCCGACGCGCTAGACGATTTCGATCTGGACATGTTGGGGGACGGGGATTCCCCGGGTCCGGGATTTACCCCCACG
ACTCCGCCCCCTACGGCGCTCTGGATATGGCCGACTTCGAGTTTGAGCAGATGTTTACCGATGCCCTTGGAATTGACGAGTACGGTGGCGGCCGCGA
CTACAAGGACGACGATGACAAG

>TALE13 +23 VP16 (SEQ ID NO: 314)
MVDLRTLGYSQQQQEKIKPKVRSTVAQHHEALVGHGFTHAHIVALSQHPAALGTVAVKYQDMIAALPEATHEATVGVGKQWSGARALEALLTVAGEL
RGPPLQLDTGQLLKIAKRGGVTAVEAVHAWRNALTGAPLNLTPEQVVAIASNIGGKQALETVQRLLPVLCQAHGLTPEQVVAIASNGGKQALETVQR
LLPVLCQAHGLTPEQVVAIASNIGGKQALETVQRLLPVLCQAHGLTPEQVVAIASNIGGKQALETVQRLLPVLCQAHGLTPAQVVAIASNIGGKQAL
ETVQRLLPVLRQAHGLTPEQVVAIASNGGKQALETVQRLLPVLCQAHGLTPAQVVAIASNIGGKQALETVQRLLPVLCQAHGLTPEQVVAIASHDGG
KQALETVQRLLPVLCQAHGLTPEQVVAIASHDGGKQALETVQRLLPVLCQAHGLTPDQVVAIASNGGGKQALETVQRLLPVLCQAHGLTPDQVVAIA
SNGGGKQALETVQRLLPVLCQAHGLTPEQVVAIASHDGGKQALETVQRLLPVLCQAHGLTPEQVVAIASNGGGRPALESIVAQLSRPDPALAALTND
HLVAGSRGRAPPTDVSLGDELHLDGEDVAMAHADALDDFDLDMLGDGDSPGPGFTPHDSAPYGALDMADFEFEQMFTDALGIDEYGGGRDYKDDDDK

>TALE13 +23 VP16 (SEQ ID NO: 315)
ATGGTGGATCTACGCACGCTCGGCTACAGCCAGCAGCAACAGGAGAAGATCAAACCGAAGGTTCGTTCGACAGTGGCGCAGCACCACGAGGCACTGG
TCGGCCATGGGTTTACACACGCGCACATCGTTGCGCTCAGCCAACACCCGGCAGCGTTAGGGACCGTCGCTGTCAAGTATCAGGACATGATCGCAGC

-continued

```
GTTGCCAGAGGCGACACACGAAGCGATCGTTGGCGTCGGCAAACAGTGGTCCGGCGCACGCGCCCTGGAGGCCTTGCTCACGGTGGCGGGAGAGTTG

AGAGGTCCACCGTTACAGTTGGACACAGGCCAACTTCTCAAGATTGCAAAACGTGGCGGCGTGACCGCAGTGGAGGCAGTGCATGCATGGCGCAATG

CACTGACGGGGGCCCCCCTGAACCTGACCCCGGAGCAGGTGGTGGCCATCGCCAGCAATATTGTGGCAAGCAGGCGCTGGAGACGGTGCAGCGGCT

GTTGCCGGTGCTGTGCCAGGCCCATGGCCTGACCCCGGAGCAGGTGGTGGCCATCGCCAGCAATGGCGGCAAGCAGGCGCTGGAGACGGTGCAGCGG

CTGTTGCCGGTGCTGTGCCAGGCCCATGGCCTGACCCCGGAGCAGGTGGTGGCCATCGCCAGCAATATTGTGGCAAGCAGGCGCTGGAGACGGTGC

AGCGGCTGTTGCCGGTGCTGTGCCAGGCCCATGGCCTGACCCCGGAGCAGGTGGTGGCCATCGCCAGCAATATTGTGGCAAGCAGGCGCTGGAGAC

GGTGCAGCGGCTGTTGCCGGTGCTGTGCCAGGCCCATGGCCTGACCCCGGCACAGGTGGTGGCCATCGCCAGCAATATTGGCGGCAAGCAGGCGCTG

GAGACGGTGCAGCGGCTGTTGCCGGTGCTGCGCCAGGCCCATGGCCTGACCCCGGAGCAGGTCGTGGCCATCGCCAGCAATGGCGGCAAGCAGGCGC

TGGAGACGGTGCAGCGGCTGTTGCCGGTGCTGTGCCAGGCCCATGGCCTGACCCCGGCACAGGTGGTGGCCATCGCCAGCAATATTGGCGGCAAGCA

GGCGCTGGAGACGGTGCAGCGGCTGTTGCCGGTGCTGTGCCAGGCCCATGGCCTGACCCCGGAGCAGGTCGTGGCCATCGCCAGCCACGATGGCGGC

AAGCAGGCGCTGGAGACGGTGCAGCGGCTGTTGCCGGTGCTGTGCCAGGCCCATGGCCTGACCCCGGAGCAGGTGGTGGCCATCGCCAGCCACGATG

GCGGCAAGCAGGCGCTGGAGACGGTGCAGCGGCTGTTGCCGGTGCTGTGCCAGGCCCATGGCCTGACCCCGGACCAGGTGGTGGCCATCGCCAGCAA

TGGCGGTGGCAAGCAGGCGCTGGAGACGGTGCAGCGGCTGTTGCCGGTGCTGTGCCAGGCCCATGGCCTGACCCCGGACCAGGTGGTGGCCATCGCC

AGCAATGGCGGTGGCAAGCAGGCGCTGGAGACGGTGCAGCGGCTGTTGCCGGTGCTGTGCCAGGCCCATGGCCTGACCCCGGAGCAGGTGGTGGCCA

TCGCCAGCCACGATGGCGGCAAGCAGGCGCTGGAGACGGTGCAGCGGCTGTTGCCGGTGCTGTGCCAGGCCCATGGCCTGACCCCGGAGCAGGTGGT

GGCCATCGCCAGCAATGGCGGCGGCAGGCCGGCGCTGGAGAGCATTGTTGCCCAGTTATCTCGCCCTGATCCGGCGTTGGCCGCGTTAACCAACGAC

CACCTCGTCGCCGGATCCCGCGGCCGCGCCCCCCGACCGATGTCAGCCTGGGGACGAGCTCCACTTAGACGGCGAGGACGTGGCGATGGCGCATG

CCGACGCGCTAGACGATTTCGATCTGGACATGTTGGGGGACGGGGATTCCCCGGGTCCGGGATTTACCCCCCACGACTCCGCCCCCTACGGCGCTCT

GGATATGGCCGACTTCGAGTTTGAGCAGATGTTTACCGATGCCCTTGGAATTGACGAGTACGGTGGCGGCCGCGACTACAAGGACGACGATGACAAG
```

>TALE13 Δ1-13 VP16 (SEQ ID NO: 316)

```
MVDLRTLGYSQQQQEKIKPKVRSTVAQHHEALVGHGFTHAHIVALSQHPAALGTVAVKYQDMIAALPEATHEAIVGVGKQWSGARALEALLTVAGEL

RGPPLQLDTGQLLKIAKRGGVTAVEAVHAWRNALTGAPLNALTNDHLVALACLGGRPALDAVKKGLPHAPALIKRTNRRIPERTSHRVADHAQVVRV

LGFFQCHSHPAQAFDDAMTQFGMSRHGLLQLFRRVGVTELEARSGTLPPASQRWDRILQASGMKRAKPSPTSTQTPDQASLHAFADSLERDLDAPSP

THEGDQRRASSRKRSRSDRAVTGPSAQQSFEVRAPEQRDALHLPLSWRVKRPRTSIGGGLPDPGTPTAADLAASSTVMREQDEDPFAGAADDFPAFN

EEELAWLMELLPQDRGRAPPTDVSLGDELHLDGEDVAMAHADALDDFDLDMLGDGDSPGPGFTPHDSAPYGALDMADFEFEQMFTDALGIDEYGGGR

DYKDDDDK
```

>TALE13 Δ1-13 VP16 (SEQ ID NO: 317)

```
ATGGTGGATCTACGCACGCTCGGCTACAGCCAGCAGCAACAGGAGAAGATCAAACCGAAGGTTCGTTCGACAGTGGCGCAGCACCACGAGGCACTGG

TCGGCCATGGGTTTACACACGCGCACATCGTTGCGCTCAGCCAACACCCGGCAGCGTTAGGGACCGTCGCTGTCAAGTATCAGGACATGATCGCAGC

GTTGCCAGAGGCGACACACGAAGCGATCGTTGGCGTCGGCAAACAGTGGTCCGGCGCACGCGCCCTGGAGGCCTTGCTCACGGTGGCGGGAGAGTTG

AGAGGTCCACCGTTACAGTTGGACACAGGCCAACTTCTCAAGATTGCAAAACGTGGCGGCGTGACCGCAGTGGAGGCAGTGCATGCATGGCGCAATG

CACTGACGGGGGCCCCCCTGAACGCGTTAACCAACGACCACCTCGTCGCCTTGGCCTGCCTCGGCGGACGTCCTGCGCTGGATGCAGTGAAAAAGGG

ATTGCCGCACGCGCCGGCCTTGATCAAAAGAACCAATCGCCGTATTCCCGAACGCACATCCCATCGCGTTGCCGACCACGCGCAAGTGGTTCGCGTG

CTGGGTTTTTTCCAGTGCCACTCCCACCCAGCGCAAGCATTTGATGACGCCATGACGCAGTTCGGGATGAGCAGGCACGGGTTGTTACAGCTCTTTC

GCAGAGTGGGCGTCACCGAACTCGAAGCCCGCAGTGGAACGCTCCCCCCAGCCTCGCAGCGTTGGGACCGTATCCTCCAGGCATCAGGGATGAAAAG

GGCCAAACCGTCCCCTACTTCAACTCAAACGCCGGACCAGGCGTCTTTGCATGCATTCGCCGATTCGCTGGAGCGTGACCTTGATGCGCCCAGCCCA

ACGCACGAGGGAGATCAGAGGCGGGCAAGCAGCCGTAAACGGTCCCGATCGGATCGTGCTGTCACCGGTCCCTCCGCACAGCAATCGTTCGAGGTGC

GCGCTCCCGAACAGCGCGATGCGCTGCATTTGCCCCTCAGTTGGAGGGTAAAACGCCCGCGTACCAGTATCGGGGCGGCCTCCCGGATCCTGGTAC

GCCCACGGCTGCCGACCTGGCAGCGTCCAGCACCGTGATGCGGGAACAAGATGAGGACCCCTTCGCAGGGGCAGCGGATGATTTCCCGGCATTCAAC
```

-continued

```
GAAGAGGAGCTCGCATGGTTGATGGAGCTATTGCCTCAGGACCGCGGCCGCGCCCCCCGACCGATGTCAGCCTGGGGACGAGCTCCACTTAGACG
GCGAGGACGTGGCGATGGCGCATGCCGACGCGCTAGACGATTTCGATCTGGACATGTTGGGGGACGGGGATTCCCCGGGTCCGGGATTTACCCCCCA
CGACTCCGCCCCCTACGGCGCTCTGGATATGGCCGACTTCGAGTTTGAGCAGATGTTTACCGATGCCCTTGGAATTGACGAGTACGGTGGCGGCCGC
GACTACAAGGACGACGATGACAAG
```

4. Miscellaneous DNA Sequences

Donor Used for the Experiment Described in FIG. 37 (SEQ ID NO:318)

```
AGCGCCCAATACGCAAACCGCCTCTCCCCGCGCGTTGGCCGATTCATTAATGCAGCTGGCACGACAGGTTTCCCGACTGGAAAGCGGGCAGTGAGCG
CAACGCAATTAATGTGAGTTAGCTCACTCATTAGGCACCCCAGGCTTTACACTTTATGCTTCCGGCTCGTATGTTGTGTGGAATTGTGAGCGGATAA
CAATTTCACACAGGAAACAGCTATGACCATGATTACGCCAAGCTCAGAATTAACCCTCACTAAAGGGACTAGTCCTGCAGGTTTAAACGAATTCGCC
CTTGATACTTATTAACCATACCTTGGAGGGGAAATCACACATGAAAAGTGTCATTTCTTTACTAATCATATTCATGTCTTTTCTCCCCATAGCAAGA
CAAAGACCTGTTTTAAACACATTTACAACCTATATGTTGCCTTGTACTAGGTAAAAAGTTGTACATTTCTGAAATAATTTTGGTATTTCTGTTCAGA
TCACTAAACTCAAGAATCAGCAATTCTCTGAGGCTTTCTTTTAAATATACATAAGGAACTTTCGGAGTGAAGGGAGAGTTTGTCAATAACTTGATGC
ATGTGAAGGGGAGATAAAAAGGTTGCTATTTTTCATCAACATATTTTGATTTGGCTTTCTATAATTGATGGGCTTAAAAGATCTAATCTACTTTAAA
CAGATGCCAAATAAATGGATGAATCTTAGACCCTCTATAACAGTAACTTCCTTTTAAAAAAGACCTCTCCCACCCCACCCCCAGCCCAGGCTGTGTA
TGAAAACTAAGCCATGTGCACAACTCTGACTGGGTCACCAGCCCACTTGAGTCCGTGTCACAAGCCCACAGATATTTCCTGCTCCCCAGTGGATCGG
GTGTAAACTGAGCTTGCTCGCTCGGGAGCCTCTTGCTGGAAAATAGAACAGCATTTGCAGAAGCGTTTGGCAATGTGCTTTTGGAAGAAGACTAAGA
GGTAGTTTCTGAACTTCTCCCCGACAAAGGCATAGATGATGGGGTTGATGCAGCAGTGCGTCATCCCAAGAGTCTCTGTCACCTGCATAGCTTGGTC
CAACCTGTTAGAGCTACTGCAATTATTCAGGCCAAAGAATTCCTGGAAGGTGTTCAGGAGAAGGACAATGTTGTAGGGAGCCCAGAAGAGAAAATAA
ACAATCATGATGGTGAAGATAAGCCTCACAGCCCTGTGCCTCTTCTTCTCATTTCGACACCGAAGCAGAGTTTTTAGGATTCCCGAGTAGCAGATGA
CCATGACAAGCAGCGGCAGGACCAGCCCCAAGATGACTATCTTTAATGTCTGGAAATTCTTCCAGAATTGATACTGACTGTATGGAAAATGAGAGCT
GCAGGTGTAATGAAGACCTTCTTTTTGAGATCTGGTAAAGATGATTCCTGGGAGAGACGCAAACACAGCCACCACCCAAGTGATCACACTTGTCACC
ACCCCAAAGGTGACCGTCCTGGCTTTTAAAGCAAACACAGCATGGACGACAGCCAGGTACCTATCGATTGTCAGGAGGATGATGAAGAAGATTCCAG
AGAAGAAGCCTATAAAATAGAGCCCTGTCAAGAGTTGACACATTGTATTTCCAAAGTCCCACTGGGCGGCAGCATAGTGAGCCCAGAAGGGGACAGT
AAGAAGGAAAAACAGGTCAGAGATGGCCAGGTTGAGCAGGTAGATGTCAGTCATGCTCTTCAGCCTTTTGCAGTTTTCTAGACGAGGCATCCAGTCC
AGACGCCATCAGGGCATACTCACTGATCTAGATGAGGATGACCAGCATGTTGCCCACAAAACCAAAGATGAACACCAGTGAGTAGAGCGGAGGCAGG
AGGCGGGCTGCGATTTGCTTCACATTGATTTTTTGGCAGGGCTCCGATGTATAATAATTGATGTCATAGATTGGACTTGACACTTGATAATCCATCT
TGTTCCACCCTGTGCATAAATAAAAAGTGATCTTTTATAAAGTCCTAGAATGTATTTAGTTGCCCTCCATGAATGCAAACTGTTTTATACATCAATA
GGTTTTTAATTGCCTACATAGATGTCTACATTGAATTAACTCTCTTTTTGGCCAAGCAATGAAGTTTTGTAGTGAAGGGAAGGTTTGCTGCTAGCTT
CCCTGTCCACTAGATGGAGAGCTTGGCTCTGTTGGGGGAATTCATGAAAGCACCATCTCACCAAATAAAATCTTGTGCTCTATAGCACCATGGAGTG
AATGAAGCTTTGACAACAATTAAGGGCGAATTCGCGGCCGCTAAATTCAATTCGCCCTATAGTGAGTCGTATTACAATTCACTGGCCGTCGTTTTAC
AACGTCGTGACTGGGAAAACCCTGGCGTTACCCAACTTAATCGCCTTGCAGCACATCCCCCTTTCGCCAGCTGGCGTAATAGCGAAGAGGCCCGCAC
CGATCGCCCTTCCCAACAGTTGCGCAGCCTATACGTACGGCAGTTTAAGGTTTACACCTATAAAAGAGAGCCGTTATCGTCTGTTTGTGGATGTA
CAGAGTGATATTATTGACACGCCGGGCGACGGATGGTGATCCCCCTGGCCAGTGCACGTCTGCTGTCAGATAAAGTCTCCCGTGAACTTTACCCGG
TGGTGCATATCGGGGATGAAAGCTGGCGCATGATGACCACCGATATGGCCAGTGTGCCGGTCTCCGTTATCGGGGAAGAAGTGGCTGATCTCAGCCA
CCGCGAAAATGACATCAAAAACGCCATTAACCTGATGTTCTGGGGAATATAAATGTCAGGCATGAGATTATCAAAAAGGATCTTCACCTAGATCCTT
TTCACGTAGAAAGCCAGTCCGCAGAAACGGTGCTGACCCCGGATGAATGTCAGCTACTGGGCTATCTGGACAAGGGAAAACGCAAGCGCAAAGAGAA
AGCAGGTAGCTTGCAGTGGGCTTACATGGCGATAGCTAGACTGGGCGGTTTTATGGACAGCAAGCGAACCGGAATTGCCAGCTGGGGCGCCCTCTGG
TAAGGTTGGGAAGCCCTGCAAAGTAAACTGGATGGCTTTCTTGCCGCCAAGGATCTGATGGCGCAGGGGATCAAGCTCTGATCAAGAGACAGGATGA
GGATCGTTTCGCATGATTGAACAAGATGGATTGCACGCAGGTTCTCCGGCCGCTTGGGTGGAGAGGCTATTCGGCTATGACTGGGCACAACAGACAA
```

-continued

```
TCGGCTGCTCTGATGCCGCCGTGTTCCGGCTGTCAGCGCAGGGGCGCCCGGTTCTTTTTGTCAAGACCGACCTGTCCGGTGCCCTGAATGAACTGCA
AGACGAGGCAGCGCGGCTATCGTGGCTGGCCACGACGGGCGTTCCTTGCGCAGCTGTGCTCGACGTTGTCACTGAAGCGGGAAGGGACTGGCTGCTA
TTGGGCGAAGTGCCGGGCAGGATCTCCTGTCATCTCACCTTGCTCCTGCCGAGAAAGTATCCATCATGGCTGATGCAATGCGGCGGCTGCATACGC
TTGATCCGGCTACCTGGCCATTCGACCACCAAGCGAAACATCGCATCGAGCGAGCACGTACTCGGATGGAAGCCGGTCTTGTCGATCAGGATGATCT
GGACGAAGAGCATCAGGGGCTCGCGCCAGCCGAACTGTTCGCCAGGCTCAAGGCGAGCATGCCCGACGGCGAGGATCTCGTCGTGACCCATGGCGAT
GCCTGCTTGCCGAATATCATGGTGGAAAATGGCCGCTTTTCTGGATTCATCGACTGTGGCCGGCTGGGTGTGGCGGACCGCTATCAGGACATAGCGT
TGGCTACCCGTGATATTGCTGAAGAGCTTGGCGGCGAATGGGCTGACCGCTTCCTCGTGCTTTACGGTATCGCCGCTCCCGATTCGCAGCGCATCGC
CTTCTATCGCCTTCTTGACGAGTTCTTCTGAATTATTAACGCTTACAATTTCCTGATGCGGTATTTTCTCCTTACGCATCTGTGCGGTATTTCACAC
CGCATCAGGTGGCACTTTTCGGGGAAATGTGCGCGGAACCCCTATTTGTTTATTTTTCTAAATACATTCAAATATGTATCCGCTCATGAGATTATCA
AAAAGGATCTTCACCTAGATCCTTTTAAATTAAAAATGAAGTTTTAAATCAATCTAAAGTATATATGAGTAAACTTGGTCTGACAGTTACCAATGCT
TAATCAGTGAGGCACCTATCTCAGCGATCTGTCTATTTCGTTCATCCATAGTTGCCTGACTCCCCGTCGTGTAGATAACTACGATACGGGAGGGCTT
ACCATCTGGCCCCAGTGCTGCAATGATACCGCGAGACCCACGCTCACCGGCTCCAGATTTATCAGCAATAAACCAGCCAGCCGGAAGGGCCGAGCGC
AGAAGTGGTCCTGCAACTTTATCCGCCTCCATCCAGTCTATTAATTGTTGCCGGGAAGCTAGAGTAAGTAGTTCGCCAGTTAATAGTTTGCGCAACG
TTGTTGCCATTGCTACAGGCATCGTGGTGTCACGCTCGTCGTTTGGTATGGCTTCATTCAGCTCCGGTTCCCAACGATCAAGGCGAGTTACATGATC
CCCCATGTTGTGCAAAAAAGCGGTTAGCTCCTTCGGTCCTCCGATCGTTGTCAGAAGTAAGTTGGCCGCAGTGTTATCACTCATGGTTATGGCAGCA
CTGCATAATTCTCTTACTGTCATGCCATCCGTAAGATGCTTTTCTGTGACTGGTGAGTACTCAACCAAGTCATTCTGAGAATAGTGTATGCGGCGAC
CGAGTTGCTCTTGCCCGGCGTCAATACGGGATAATACCGCGCCACATAGCAGAACTTTAAAAGTGCTCATCATTGGAAAACGTTCTTCGGGGCGAAA
ACTCTCAAGGATCTTACCGCTGTTGAGATCCAGTTCGATGTAACCCACTCGTGCACCCAACTGATCTTCAGCATCTTTTACTTTCACCAGCGTTTCT
GGGTGAGCAAAAACAGGAAGGCAAAATGCCGCAAAAAAGGGAATAAGGGCGACACGGAAATGTTGAATACTCATACTCTTCCTTTTTCAATATTATT
GAAGCATTTATCAGGGTTATTGTCTCATGACCAAAATCCCTTAACGTGAGTTTTCGTTCCACTGAGCGTCAGACCCCGTAGAAAAGATCAAAGGATC
TTCTTGAGATCCTTTTTTTCTGCGCGTAATCTGCTGCTTGCAAACAAAAAAACCACCGCTACCAGCGGTGGTTTGTTTGCCGGATCAAGAGCTACCA
ACTCTTTTTCCGAAGGTAACTGGCTTCAGCAGAGCGCAGATACCAAATACTGTTCTTCTAGTGTAGCCGTAGTTAGGCCACCACTTCAAGAACTCTG
TAGCACCGCCTACATACCTCGCTCTGCTAATCCTGTTACCAGTGGCTGCTGCCAGTGGCGATAAGTCGTGTCTTACCGGGTTGGACTCAAGACGATA
GTTACCGGATAAGGCGCAGCGGTCGGGCTGAACGGGGGGTTCGTGCACACAGCCCAGCTTGGAGCGAACGACCTACACCGAACTGAGATACCTACAG
CGTGAGCTATGAGAAAGCGCCACGCTTCCCGAAGGGAGAAAGGCGGACAGGTATCCGGTAAGCGGCAGGGTCGGAACAGGAGAGCGCACGAGGGAGC
TTCCAGGGGGAAACGCCTGGTATCTTTATAGTCCTGTCGGGTTTCGCCACCTCTGACTTGAGCGTCGATTTTTGTGATGCTCGTCAGGGGGCGGAG
CCTATGGAAAAACGCCAGCAACGCGGCCTTTTTACGGTTCCTGGCCTTTTGCTGGCCTTTTGCTCACATGTTCTTTCCTGCGTTATCCCCTGATTCT
GTGGATAACCGTATTACCGCCTTTGAGTGAGCTGATACCGCTCGCCGCAGCCGAACGACCGAGCGCAGCGAGTCAGTGAGCGAGGAAGCGGAAG
```

TALE13 Reporter Construct (TALE13 BINDING SITES AND SV40 PROMOTER UNDERLINED) (SEQ ID NO:319):

```
GGTACCGAGCTCTTACGCGTGCTAGTATAAATACCTTCTGCCTTACTAGTATAAATACCTTCTGCCTTGCTAGCTCGAGATCTGCGATCTGCATCTC
AATTAGTCAGCAACCATAGTCCCGCCCCTAACTCCGCCCATCCCGCCCCTAACTCCGCCCAGTTCCGCCCATTCTCCGCCCCATCGCTGACTAATTT
TTTTTATTTATGCAGAGGCCGAGGCCGCCTCGGCCTCTGAGCTATTCCAGAAGTAGTGAGGAGGCTTTTTTGGAGGCCTAGGCTTTTGCAAAAAGCT
TGGCATTCCGGTACTGTTGGTAAAGCCACCATGGAAGACGCCAAAAACATAAAGAAAGGCCCGGCGCCATTCTATCCGCTGGAAGATGGAACCGCTG
GAGAGCAACTGCATAAGGCTATGAAGAGATACGCCCTGGTTCCTGGAACAATTGCTTTTACAGATGCACATATCGAGGTGGACATCACTTACGCTGA
GTACTTCGAAATGTCCGTTCGGTTGGCAGAAGCTATGAAACGATATGGGCTGAATACAAATCACAGAATCGTCGTATGCAGTGAAAACTCTCTTCAA
TTCTTTATGCCGGTGTTGGGCGCGTTATTTATCGGAGTTGCAGTTGCGCCCGCGAACGACATTTATAATGAACGTGAATTGCTCAACAGTATGGGCA
TTTCGCAGCCTACCGTGGTGTTCGTTTCCAAAAAGGGGTTGCAAAAAATTTTGAACGTGCAAAAAAAGCTCCCAATCATCCAAAAAATTATTATCAT
GGATTCTAAAACGGATTACCAGGGATTTCAGTCGATGTACACGTTCGTCACATCTCATCTACCTCCCGGTTTTAATGAATACGATTTTGTGCCAGAG
```

-continued
TCCTTCGATAGGGACAAGACAATTGCACTGATCATGAACTCCTCTGGATCTACTGGTCTGCCTAAAGGTGTCGCTCTGCCTCATAGAACTGCCTGCG
TGAGATTCTCGCATGCCAGAGATCCTATTTTTGGCAATCAAATCATTCCGGATACTGCGATTTTAAGTGTTGTTCCATTCCATCACGGTTTTGGAAT
GTTTACTACACTCGGATATTTGATATGTGGATTTCGAGTCGTCTTAATGTATAGATTTGAAGAAGAGCTGTTTCTGAGGAGCCTTCAGGATTACAAG
ATTCAAAGTGCGCTGCTGGTGCCAACCCTATTCTCCTTCTTCGCCAAAAGCACTCTGATTGACAAATACGATTTATCTAATTTACACGAAATTGCTT
CTGGTGGCGCTCCCCTCTCTAAGGAAGTCGGGGAAGCGGTTGCCAAGAGGTTCCATCTGCCAGGTATCAGGCAAGGATATGGGCTCACTGAGACTAC
ATCAGCTATTCTGATTACACCCGAGGGGGATGATAAACCGGGCGCGGTCGGTAAAGTTGTTCCATTTTTTGAAGCGAAGGTTGTGGATCTGGATACC
GGGAAAACGCTGGGCGTTAATCAAAGAGGCGAACTGTGTGTGAGAGGTCCTATGATTATGTCCGGTTATGTAAACAATCCGGAAGCGACCAACGCCT
TGATTGACAAGGATGGATGGCTACATTCTGGAGACATAGCTTACTGGGACGAAGACGAACACTTCTTCATCGTTGACCGCCTGAAGTCTCTGATTAA
GTACAAAGGCTATCAGGTGGCTCCCGCTGAATTGGAATCCATCTTGCTCCAACACCCCAACATCTTCGACGCAGGTGTCGCAGGTCTTCCCGACGAT
GACGCCGGTGAACTTCCCGCCGCCGTTGTTGTTTTGGAGCACGAAAGACGATGACGGAAAAAGAGATCGTGGATTACGTCGCCAGTCAAGTAACAA
CCGCGAAAAAGTTGCGCGGAGGAGTTGTGTTTGTGGACGAAGTACCGAAAGGTCTTACCGGAAAACTCGACGCAAGAAAAATCAGAGAGATCCTCAT
AAAGGCCAAGAAGGGCGGAAAGATCGCCGTGTAATTCTAGAGTCGGGGCGGCCGGCCGCTTCGAGCAGACATGATAAGATACATTGATGAGTTTGGA
CAAACCACAACTAGAATGCAGTGAAAAAAATGCTTTATTTGTGAAATTTGTGATGCTATTGCTTTATTTGTAACCATTATAAGCTGCAATAAACAAG
TTAACAACAACAATTGCATTCATTTTATGTTTCAGGTTCAGGGGAGGTGTGGGAGGTTTTTTAAAGCAAGTAAAACCTCTACAAATGTGGTAAAAT
CGATAAGGATCCGTCGACCGATGCCCTTGAGAGCCTTCAACCCAGTCAGCTCCTTCCGGTGGGCGCGGGGCATGACTATCGTCGCCGCACTTATGAC
TGTCTTCTTTATCATGCAACTCGTAGGACAGGTGCCGGCAGCGCTCTTCCGCTTCCTCGCTCACTGACTCGCTGCGCTCGGTCGTTCGGCTGCGGCG
AGCGGTATCAGCTCACTCAAAGGCGGTAATACGGTTATCCACAGAATCAGGGGATAACGCAGGAAAGAACATGTGAGCAAAAGGCCAGCAAAAGGCC
AGGAACCGTAAAAAGGCCGCGTTGCTGGCGTTTTTCCATAGGCTCCGCCCCCCTGACGAGCATCACAAAAATCGACGCTCAAGTCAGAGGTGGCGAA
ACCCGACAGGACTATAAAGATACCAGGCGTTTCCCCCTGGAAGCTCCCTCGTGCGCTCTCCTGTTCCGACCCTGCCGCTTACCGGATACCTGTCCGC
CTTTCTCCCTTCGGGAAGCGTGGCGCTTTCTCATAGCTCACGCTGTAGGTATCTCAGTTCGGTGTAGGTCGTTCGCTCCAAGCTGGGCTGTGTGCAC
GAACCCCCCGTTCAGCCCGACCGCTGCGCCTTATCCGGTAACTATCGTCTTGAGTCCAACCCGGTAAGACACGACTTATCGCCACTGGCAGCAGCCA
CTGGTAACAGGATTAGCAGAGCGAGGTATGTAGGCGGTGCTACAGAGTTCTTGAAGTGGTGGCCTAACTACGGCTACACTAGAAGAACAGTATTTGG
TATCTGCGCTCTGCTGAAGCCAGTTACCTTCGGAAAAAGAGTTGGTAGCTCTTGATCCGGCAAACAAACCACCGCTGGTAGCGGTGGTTTTTTTGTT
TGCAAGCAGCAGATTACGCGCAGAAAAAAAGGATCTCAAGAAGATCCTTTGATCTTTTCTACGGGGTCTGACGCTCAGTGGAACGAAAACTCACGTT
AAGGGATTTTGGTCATGAGATTATCAAAAAGGATCTTCACCTAGATCCTTTTAAATTAAAAATGAAGTTTTAAATCAATCTAAAGTATATATGAGTA
AACTTGGTCTGACAGTTACCAATGCTTAATCAGTGAGGCACCTATCTCAGCGATCTGTCTATTTCGTTCATCCATAGTTGCCTGACTCCCCGTCGTG
TAGATAACTACGATACGGGAGGGCTTACCATCTGGCCCCAGTGCTGCAATGATACCGCGAGACCCACGCTCACCGGCTCCAGATTTATCAGCAATAA
ACCAGCCAGCCGGAAGGGCCGAGCGCAGAAGTGGTCCTGCAACTTTATCCGCCTCCATCCAGTCTATTAATTGTTGCCGGGAAGCTAGAGTAAGTAG
TTCGCCAGTTAATAGTTTGCGCAACGTTGTTGCCATTGCTACAGGCATCGTGGTGTCACGCTCGTCGTTTGGTATGGCTTCATTCAGCTCCGGTTCC
CAACGATCAAGGCGAGTTACATGATCCCCCATGTTGTGCAAAAAAGCGGTTAGCTCCTTCGGTCCTCCGATCGTTGTCAGAAGTAAGTTGGCCGCAG
TGTTATCACTCATGGTTATGGCAGCACTGCATAATTCTCTTACTGTCATGCCATCCGTAAGATGCTTTTCTGTGACTGGTGAGTACTCAACCAAGTC
ATTCTGAGAATAGTGTATGCGGCGACCGAGTTGCTCTTGCCCGGCGTCAATACGGGATAATACCGCGCCACATAGCAGAACTTTAAAAGTGCTCATC
ATTGGAAAACGTTCTTCGGGGCGAAAACTCTCAAGGATCTTACCGCTGTTGAGATCCAGTTCGATGTAACCCACTCGTGCACCCAACTGATCTTCAG
CATCTTTTACTTTCACCAGCGTTTCTGGGTGAGCAAAAACAGGAAGGCAAAATGCCGCAAAAAAGGGAATAAGGGCGACACGGAAATGTTGAATACT
CATACTCTTCCTTTTTCAATATTATTGAAGCATTTATCAGGGTTATTGTCTCATGAGCGGATACATATTTGAATGTATTTAGAAAAATAAACAAATA
GGGGTTCCGCGCACATTTCCCCGAAAAGTGCCACCTGACGCGCCCTGTAGCGGCGCATTAAGCGCGGCGGGTGTGGTGGTTACGCGCAGCGTGACCG
CTACACTTGCCAGCGCCCTAGCGCCCGCTCCTTTCGCTTTCTTCCCTTCCTTTCTCGCCACGTTCGCCGGCTTTCCCCGTCAAGCTCTAAATCGGGG
GCTCCCTTTAGGGTTCCGATTTAGTGCTTTACGGCACCTCGACCCCAAAAAACTTGATTAGGGTGATGGTTCACGTAGTGGGCCATCGCCCTGATAG
ACGGTTTTTCGCCCTTTGACGTTGGAGTCCACGTTCTTTAATAGTGGACTCTTGTTCCAAACTGGAACAACACTCAACCCTATCTCGGTCTATTCTT
TTGATTTATAAGGGATTTTGCCGATTTCGGCCTATTGGTTAAAAAATGAGCTGATTTAACAAAAATTTAACGCGAATTTTAACAAAATATTAACGCT
TACAATTTGCCATTCGCCATTCAGGCTGCGCAACTGTTGGGAAGGGCGATCGGTGCGGGCCTCTTCGCTATTACGCCAGCCCAAGCTACCATGATAA -continued

```
GTAAGTAATATTAAGGTACGGGAGGTACTTGGAGCGGCCGCAATAAAATATCTTTATTTTCATTACATCTGTGTGTTGGTTTTTTGTGTGAATCGAT

AGTACTAACATACGCTCTCCATCAAAACAAAACGAAACAAAACAAACTAGCAAAATAGGCTGTCCCCAGTGCAAGTGCAGGTGCCAGAACATTTCTC

TATCGATA
```

DNA Sequence of TALE13 (SEQ ID NO:320):

```
GTGGATCTACGCACGCTCGGCTACAGCCAGCAGCAACAGGAGAAGATCAAACCGAAGGTTCGTTCGACAGTGGCGCAGCACCACGAGGCACTGGTCG

GCCATGGGTTTACACACGCGCACATCGTTGCGCTCAGCCAACACCCGGCAGCGTTAGGGACCGTCGCTGTCAAGTATCAGGACATGATCGCAGCGTT

GCCAGAGGCGACACACGAAGCGATCGTTGGCGTCGGCAAACAGTGGTCCGGCGCACGCGCCCTGGAGGCCTTGCTCACGGTGGCGGGAGAGTTGAGA

GGTCCACCGTTACAGTTGGACACAGGCCAACTTCTCAAGATTGCAAAACGTGGCGGCGTGACCGCAGTGGAGGCAGTGCATGCATGGCGCAATGCAC

TGACGGGTGCCCCCCTGAACCTGACCCCGGAGCAGGTGGTGGCCATCGCCAGCAATATTGGTGGCAAGCAGGCGCTGGAGACGGTGCAGCGGCTGTT

GCCGGTGCTGTGCCAGGCCCATGGCCTGACCCCGGAGCAGGTGGTGGCCATCGCCAGCAATGGCGGCAAGCAGGCGCTGGAGACGGTGCAGCGGCTG

TTGCCGGTGCTGTGCCAGGCCCATGGCCTGACCCCGGAGCAGGTGGTGGCCATCGCCAGCAATATTGGTGGCAAGCAGGCGCTGGAGACGGTGCAGC

GGCTGTTGCCGGTGCTGTGCCAGGCCCATGGCCTGACCCCGGAGCAGGTGGTGGCCATCGCCAGCAATATTGGTGGCAAGCAGGCGCTGGAGACGGT

GCAGCGGCTGTTGCCGGTGCTGTGCCAGGCCCATGGCCTGACCCCGCACAGGTGGTGGCCATCGCCAGCAATATTGGCGGCAAGCAGGCGCTGGAG

ACGGTGCAGCGGCTGTTGCCGGTGCTGCGCCAGGCCCATGGCCTGACCCCGGAGCAGGTCGTGGCCATCGCCAGCAATGGCGGCAAGCAGGCGCTGG

AGACGGTGCAGCGGCTGTTGCCGGTGCTGTGCCAGGCCCATGGCCTGACCCCGGACAGGTGGTGGCCATCGCCAGCAATATTGGCGGCAAGCAGGC

GCTGGAGACGGTGCAGCGGCTGTTGCCGGTGCTGTGCCAGGCCCATGGCCTGACCCCGGAGCAGGTCGTGGCCATCGCCAGCCACGATGGCGGCAAG

CAGGCGCTGGAGACGGTGCAGCGGCTGTTGCCGGTGCTGTGCCAGGCCCATGGCCTGACCCCGGAGCAGGTGGTGGCCATCGCCAGCCACGATGGCG

GCAAGCAGGCGCTGGAGACGGTGCAGCGGCTGTTGCCGGTGCTGTGCCAGGCCCATGGCCTGACCCCGGACCAGGTGGTGGCCATCGCCAGCAATGG

CGGTGGCAAGCAGGCGCTGGAGACGGTGCAGCGGCTGTTGCCGGTGCTGTGCCAGGCCCATGGCCTGACCCCGGACCAGGTGGTGGCCATCGCCAGC

AATGGCGGTGGCAAGCAGGCGCTGGAGACGGTGCAGCGGCTGTTGCCGGTGCTGTGCCAGGCCCATGGCCTGACCCCGGAGCAGGTGGTGGCCATCG

CCAGCCACGATGGCGGCAAGCAGGCGCTGGAGACGGTGCAGCGGCTGTTGCCGGTGCTGTGCCAGGCCCATGGCCTGACCCCGGAGCAGGTGGTGGC

CATCGCCAGCAATGGCGGCGGCAGGCCGGCGCTGGAGAGCATTGTTGCCCAGTTATCTCGCCCTGATCCGGCGTTGGCCGCGTTGACCAACGACCAC

CTCGTCGCCTTGGCCTGCCTCGGCGGACGTCCTGCGCTGGATGCAGTGAAAAAGGGATTGCCGCACGCGCCGGCCTTGATCAAAAGAACCAATCGCC

GTATTCCCGAACGCACATCCCATCGCGTTGCCGACCACGCGCAAGTGGTTCGCGTGCTGGGTTTTTTCCAGTGCCACTCCCACCCAGCGCAAGCATT

TGATGACGCCATGACGCAGTTCGGGATGAGCAGGCACGGGTTGTTACAGCTCTTTCGCAGAGTGGGCGTCACCGAACTCGAAGCCCGCAGTGGAACG

CTCCCCCCAGCCTCGCAGCGTTGGGACCGTATCCTCCAGGCATCAGGGATGAAAAGGGCCAAACCGTCCCCTACTTCAACTCAAACGCCGGACCAGG

CGTCTTTGCATGCATTCGCCGATTCGCTGGAGCGTGACCTTGATGCGCCCAGCCCAACGCACGAGGGAGATCAGAGGCGGGCAAGCAGCCGTAAACG

GTCCCGATCGGATCGTGCTGTCACCGGTCCCTCCGCACAGCAATCGTTCGAGGTGCGCGCTCCCGAACAGCGCGATGCGCTGCATTTGCCCCTCAGT

TGGAGGGTAAAACGCCCGCGTACCAGTATCGGGGCGGCCTCCCGGATCCTGGTACGCCCACGGCTGCCGACCTGGCAGCGTCCAGCACCGTGATGC

GGGAACAAGATGAGGACCCCTTCGCAGGGGCAGCGGATGATTTCCCGGCATTCAACGAAGAGGAGCTCGCATGGTTGATGGAGCTATTGCCTCAG
```

Protein and Gene Sequences of TALEs VEGF-1 and CCR5-1

```
>VEGF-1
                                                                                    (SEQ ID NO: 321)
VDLRTLGYSQQQQEKIKPKVRSTVAQHHEALVGHGFTHAHIVALSQHPAALGTVAVKYQDMIAALPEATHEAIVGVGKQWSGARALEALLTVAGELR

GPPLQLDTGQLLKIAKRGGVTAVEAVHAWRNALTGAPLNLTPQQVVAIASNNGGKQALETVQRLLPVLCQAHGLTPQQVVAIASNIGGKQALETVQR

LLPVLCQAHGLTPEQVVAIASNNGGKQALETVQRLLPVLCQAHGLTPEQVVAIASHDGGKQALETVQALLPVLCQAHGLTPEQVVAIASHDGGKQAL

ETVQALLPVLCQAHGLTPEQVVAIASHDGGKQALETVQALLPVLCQAHGLTPEQVVAIASNGGGKQALETVQRLLPVLCQAHGLTPEQVVAIASHDG

GKQALETVQRLLPVLCQAHGLTPEQVVAIASHDGGKQALETVQRLLPVLCQAHGLTPEQVVAIASHDGGKQALETVQRLLPVLCQAHGLTPEQVVAI

ASHDGGKQALETVQRLLPVLCQAHGLTPEQVVAIASHDGGKQALETVQRLLPVLCQAHGLTPEQVVAIASNGGGKQALETVQRLLPVLCQAHGLTPQ
```

QVVAIASNGGGRPALESIVAQLSRPDPALAALTNDHLVALACLGGRPALDAVKKGLPHAPALIKRTNRRIPERTSHRVADHAQVVRVLGFFQCHSHP
AQAFDDAMTQFGMS

>VEGF-1

(SEQ ID NO: 322)

GTGGATCTACGCACGCTCGGCTACAGCCAGCAGCAACAGGAGAAGATCAAACCGAAGGTTCGTTCGACAGTGGCGCAGCACCACGAGGCACTGGTCG
GCCATGGGTTTACACACGCGCACATCGTTGCGCTCAGCCAACACCCGGCAGCGTTAGGGACCGTCGCTGTCAAGTATCAGGACATGATCGCAGCGTT
GCCAGAGGCGACACACGAAGCGATCGTTGGCGTCGGCAAACAGTGGTCCGGCGCACGCGCCCTGGAGGCCTTGCTCACGGTGGCGGGAGAGTTGAGA
GGTCCACCGTTACAGTTGGACACAGGCCAACTTCTCAAGATTGCAAAACGTGGCGGCGTGACCGCAGTGGAGGCAGTGCATGCATGGCGCAATGCAC
TGACGGGGGCCCCCCTGAACCTGACGCCTCAACAGGTCGTCGCGATAGCGTCTAATAATGGAGGAAAGCAAGCTCTGGAAACCGTCCAGCGACTCCT
TCCGGTTCTGTGCCAGGCTCATGGTCTGACTCCGCAGCAAGTCGTTGCTATAGCGTCCAACATCGGAGGCAAACAGGCCCTGGAGACCGTGCAGCGG
TTGTTGCCTGTGCTTTGCCAAGCCCACGGGCTTACGCCTGAGCAAGTGGTGGCGATTGCCAGTAACAACGGCGGCAAACAAGCCCTTGAGACTGTGC
AGAGGCTCTTGCCGGTACTCTGCCAAGCACACGGCTTGACCCCCGAGCAGGTTGTAGCCATAGCTAGTCACGACGGGGGTAAGCAAGCGTTGGAAAC
GGTGCAAGCACTTCTCCCCGTTCTCTGTCAAGCGCATGGACTTACCCCGGAACAGGTGGTCGCCATTGCAAGCCATGATGGGGGTAAGCAAGCGTTG
GAAACGGTGCAAGCACTTCTCCCCGTTCTCTGTCAAGCGCATGGACTTACCCCGGAACAGGTGGTCGCCATTGCAAGCCATGATGGAGGAAAGCAGG
CGCTCGAAACAGTCCAGGCACTTTTGCCCGTACTTTGTCAAGCTCACGGTCTCACCCCGGAACAGGTGGTAGCCATTGCATCTAACGGAGGGGGCAA
ACAAGCCTTGGAGACAGTGCAAAGGCTCCTGCCAGTGCTCTGCCAGGCTCATGGTTTGACACCCGAACAGGTAGTTGCAATAGCGAGTCATGATGGC
GGAAAGCAAGCTCTTGAAACTGTGCAGCGGCTGTTGCCTGTACTGTGTCAAGCCCACGGGCTGACACCGGAACAAGTTGTAGCGATCGCTAGCCACG
ATGGCGGGAAACAAGCTCTGGAAACGGTACAGAGACTCCTCCCAGTGCTTTGTCAGGCACACGGCCTCACGCCAGAGCAGGTTGTCGCCATCGCGTC
ACATGATGGGGCAAACAAGCCTTGGAGACAGTGCAAAGGCTCCTGCCAGTGCTCTGCCAGGCTCATGGTTTGACACCCGAACAGGTAGTTGCAATA
GCGAGTCATGATGGCGGAAAGCAAGCTCTTGAAACTGTGCAGCGGCTGTTGCCTGTACTGTGTCAAGCCCACGGGCTGACACCGGAACAAGTTGTAG
CGATCGCTAGCCACGATGGCGGGAAACAAGCTCTGGAAACGGTACAGAGACTCCTCCCAGTGCTTTGTCAGGCACACGGCCTCACGCCAGAGCAGGT
TGTCGCCATCGCGTCAAACGGTGGAGGGAAACAAGCGCTCGAAACCGTGCAAAGGTTGCTCCCCGTTCTCTGTCAGGCGCACGGTCTTACGCCACAA
CAGGTGGTGGCGATTGCATCTAATGGAGGCGGACGCCCTGCCTTGGAGAGCATTGTGGCCCAGCTGTCCAGGCCGGACCCTGCCCTGGCCGCGTTAA
CCAACGACCACCTCGTCGCCTTGGCCTGCCTCGGCGGACGTCCTGCGCTGGATGCAGTGAAAAAGGGATTGCCGCACGCGCCGGCCTTGATCAAAAG
AACCAATCGCCGTATTCCCGAACGCACATCCCATCGCGTTGCCGACCACGCGCAAGTGGTTCGCGTGCTGGGTTTTTTCCAGTGCCACTCCCACCCA
GCGCAAGCATTTGATGACGCCATGACGCAGTTCGGGATGAGC

>CCR5-1

(SEQ ID NO: 323)

VDLRTLGYSQQQQEKIKPKVRSTVAQHHEALVGHGFTHAHIVALSQHPAALGTVAVKYQDMIAALPEATHEAIVGVGKQWSGARALEALLTVAGELR
GPPLQLDTGQLLKIAKRGGVTAVEAVHAWRNALTGAPLNLTPEQVVAIASNKGGKQALETVQALLPVLCQAHGLTPEQVVAIASHDGGKQALETVQA
LLPVLCQAHGLTPEQVVAIASNGGGKQALETVQRLLPVLCQAHGLTPEQVVAIASHDGGKQALETVQRLLPVLCQAHGLTPEQVVAIASNGGGKQAL
ETVQALLPVLCQAHGLTPEQVVAIASNGGGKQALETVQRLLPVLCQAHGLTPEQVVAIASHDGGKQALETVQRLLPVLCQAHGLTPQQVVAIASNIG
GKQALETVQRLLPVLCQAHGLTPEQVVAIASNNGGKQALETVQRLLPVLCQAHGLTPEQVVAIASHDGGKQALETVQRLLPVLCQAHGLTPEQVVAI
ASHDGGKQALETVQRLLPVLCQAHGLTPEQVVAIASNGGGKQALETVQRLLPVLCQAHGLTPQQVVAIASNGGGRPALESIVAQLSRPDPALAALTN
DHLVALACLGGRPALDAVKKGLPHAPALIKRTNRRIPERTSHRVADHAQVVRVLGFFQCHSHPAQAFDDAMTQFGMS

>CCR5-1

(SEQ ID NO: 324)

GTGGATCTACGCACGCTCGGCTACAGCCAGCAGCAACAGGAGAAGATCAAACCGAAGGTTCGTTCGACAGTGGCGCAGCACCACGAGGCACTGGTCG
GCCATGGGTTTACACACGCGCACATCGTTGCGCTCAGCCAACACCCGGCAGCGTTAGGGACCGTCGCTGTCAAGTATCAGGACATGATCGCAGCGTT
GCCAGAGGCGACACACGAAGCGATCGTTGGCGTCGGCAAACAGTGGTCCGGCGCACGCGCCCTGGAGGCCTTGCTCACGGTGGCGGGAGAGTTGAGA
GGTCCACCGTTACAGTTGGACACAGGCCAACTTCTCAAGATTGCAAAACGTGGCGGCGTGACCGCAGTGGAGGCAGTGCATGCATGGCGCAATGCAC
TGACGGGGGCCCCCCTGAACCTTACACCCGAGCAAGTAGTGGCTATTGCGAGTAATAAAGGGGGTAAGCAAGCGTTGGAAACGGTGCAAGCACTTCT
CCCCGTTCTCTGTCAAGCGCATGGACTTACCCCGGAACAGGTGGTCGCCATTGCAAGCCATGATGGAGGAAAGCAGGCGCTCGAAACAGTCCAGGCA

```
CTTTTGCCCGTACTTTGTCAAGCTCACGGTCTCACCCCGGAACAGGTGGTAGCCATTGCATCTAACGGAGGGGGCAAACAAGCCTTGGAGACAGTGC
AAAGGCTCCTGCCAGTGCTCTGCCAGGCTCATGGTTTGACACCCGAACAGGTAGTTGCAATAGCGAGTCATGATGGCGGAAAGCAAGCTCTTGAAAC
TGTGCAGCGGCTGTTGCCTGTACTGTGTCAAGCCCACGGGCTGACACCGGAACAAGTTGTAGCGATCGCTAGCAACGGCGGAGGTAAGCAAGCATTG
GAAACGGTTCAGGCCCTGTTGCCTGTACTTTGCCAGGCGCACGGTCTGACACCTGAGCAGGTTGTCGCCATCGCTAGCAACGGAGGTGGGAAACAGG
CACTTGAAACTGTGCAGAGGCTTCTGCCGGTGCTGTGCCAAGCGCATGGCCTTACACCCGAGCAAGTAGTGGCTATTGCGAGTCATGATGGAGGCAA
GCAAGCGCTGGAGACTGTCCAACGACTTCTTCCGGTCTTGTGTCAGGCACATGGATTGACCCCTCAACAAGTCGTGGCGATAGCTAGCAACATCGGA
GGCAAACAGGCCCTGGAGACCGTGCAGCGGTTGTTGCCTGTGCTTTGCCAAGCCCACGGGCTTACGCCTGAGCAAGTGGTGGCGATTGCCAGTAACA
ACGGGGGCAAACAAGCCTTGGAGACAGTGCAAAGGCTCCTGCCAGTGCTCTGCCAGGCTCATGGTTTGACACCCGAACAGGTAGTTGCAATAGCGAG
TCATGATGGCGGAAAGCAAGCTCTTGAAACTGTGCAGCGGCTGTTGCCTGTACTGTGTCAAGCCCACGGGCTGACACCGGAACAAGTTGTAGCGATC
GCTAGCCACGATGGCGGGAAACAAGCTCTGGAAACGGTACAGAGACTCCTCCCAGTGCTTTGTCAGGCACACGGCCTCACGCCAGAGCAGGTTGTCG
CCATCGCGTCAAACGGTGGAGGGAAACAAGCGCTCGAAACCGTGCAAAGGTTGCTCCCCGTTCTCTGTCAGGCGCACGGTCTTACGCCACAACAGGT
GGTGGCGATTGCATCTAATGGAGGCGGACGCCCTGCCTTGGAGAGCATTGTGGCCCAGCTGTCCAGGCCGGACCCTGCCCTGGCCGCGTTAACCAAC
GACCACCTCGTCGCCTTGGCCTGCCTCGGCGGACGTCCTGCGCTGGATGCAGTGAAAAAGGGATTGCCGCACGCGCCGGCCTTGATCAAAAGAACCA
ATCGCCGTATTCCCGAACGCACATCCCATCGCGTTGCCGACCACGCGCAAGTGGTTCGCGTGCTGGGTTTTTTCCAGTGCCACTCCCACCCAGCGCA
AGCATTTGATGACGCCATGACGCAGTTCGGGATGAGC
```

Gene Sequences of AAVS1-Specific TALENs

```
101077 ORF (TALE region underlined) (SEQ ID NO: 325):
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASHDGGKQA
LETVQRLLPVLCQDHGLTPEQVVAIASHDGGKQALETVQRLLPVLCQAHGLTPDQVVAIASHDGGKQALETVQRLLPVLCQAHGLTPAQVVAIASHD
GGKQALETVQRLLPVLCQDHGLTPDQVVAIASNGGGKQALETVQRLLPVLCQDHGLTPEQVVAIASHDGGKQALETVQRLLPVLCQAHGLTPDQVVA
IASHDGGKQALETVQRLLPVLCQAHGLTPAQVVAIASNIGGKQALETVQRLLPVLCQDHGLTPDQVVAIASHDGGKQALETVQRLLPVLCQDHGLTP
EQVVAIASHDGGKQALETVQRLLPVLCQAHGLTPDQVVAIASHDGGKQALETVQRLLPVLCQAHGLTPAQVVAIASHDGGKQALETVQRLLPVLCQD
HGLTPDQVVAIASNIGGKQALETVQRLLPVLCQDHGLTPEQVVAIASHDGGKQALETVQRLLPVLCQAHGLTPDQVVAIASNIGGKQALETVQRLLP
VLCQAHGLTPAQVVAIANNNGGKQALETVQRLLPVLCQDHGLTPEQVVAIASNGGGRPALESIVAQLSRPDPALAALTNDHLVALACLGGRPALDAV
KKGLPHAPALIKRTNRRIPERTSHRVAGSQLVKSELEEKKSELRHKLKYVPHEYIELIEIARNSTQDRILEMKVMEFFMKVYGYRGKHLGGSRKPDG
AIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSV
EELLIGGEMIKAGTLTLEEVRRKFNNGEINFRS 101079 ORF (TALE region underlined) (SEQ ID NO: 326):
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASNGGGKQA
LETVQRLLPVLCQDHGLTPEQVVAIASNGGGKQALETVQRLLPVLCQDHGLTPDQVVAIASNGGGKQALETVQRLLPVLCQAHGLTPAQVVAIASHD
GGKQALETVQRLLPVLCQDHGLTPDQVVAIASNGGGKQALETVQRLLPVLCQDHGLTPDQVVAIANNNGGKQALETVQRLLPVLCQAHGLTPDQVVA
IASNGGGKQALETVQRLLPVLCQAHGLTPAQVVAIASHDGGKQALETVQRLLPVLCQDHGLTPDQVVAIASNIGGKQALETVQRLLPVLCQDHGLTP
EQVVAIASHDGGKQALETVQRLLPVLCQAHGLTPDQVVAIASHDGGKQALETVQRLLPVLCQAHGLTPAQVVAIASNIGGKQALETVQRLLPVLCQD
HGLTPDQVVAIASNIGGKQALETVQRLLPVLCQDHGLTPEQVVAIASNGGGKQALETVQRLLPVLCQAHGLTPDQVVAIASHDGGKQALETVQRLLP
VLCQAHGLTPAQVVAIASHDGGKQALETVQRLLPVLCQDHGLTPEQVVAIASNGGGRPALESIVAQLSRPDPALAALTNDHLVALACLGGRPALDAV
KKGLPHAPALIKRTNRRIPERTSHRVAGSQLVKSELEEKKSELRHKLKYVPHEYIELIEIARNSTQDRILEMKVMEFFMKVYGYRGKHLGGSRKPDG
AIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSV
EELLIGGEMIKAGTLTLEEVRRKFNNGEINFRS
```

Sequence of ben-1 Specific TALENs ORFS:

101318

(SEQ ID NO: 327)

MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASHDGGKQA
LETVQRLLPVLCQDHGLTPEQVVAIASHDGGKQALETVQRLLPVLCQAHGLTPDQVVAIASNIGGKQALETVQRLLPVLCQAHGLTPAQVVAIANNN
GGKQALETVQRLLPVLCQDHGLTPDQVVAIASHDGGKQALETVQRLLPVLCQDHGLTPEQVVAIASHDGGKQALETVQRLLPVLCQAHGLTPDQVVA
IASNGGGKQALETVQRLLPVLCQAHGLTPAQVVAIANNNGGKQALETVQRLLPVLCQDHGLTPDQVVAIASNIGGKQALETVQRLLPVLCQDHGLTP
EQVVAIASNGGGKQALETVQRLLPVLCQAHGLTPDQVVAIANNNGGKQALETVQRLLPVLCQAHGLTPAQVVAIANNNGGKQALETVQRLLPVLCQD
HGLTPDQVVAIASNIGGKQALETVQRLLPVLCQAHGLTPAQVVAIASNIGGKQALETVQRLLPVLCQDHGLTPEQVVAIASNGGGRPALESIVAQLS
RPDPALAALTNDHLVALACLGGRPALDAVKKGLPHAPALIKRTNRRIPERTSHRVAGSQLVKSELEEKKSELRHKLKYVPHEYIELIEIARNSTQDR
ILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLF
VSGHFKGNYKAQLTRLNHITNCNGAVLSVEELLIGGEMIKAGTLTLEEVRRKFNNGEINFRS

101321

(SEQ ID NO: 328)

MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVK
YQDMIAALPEATHEAIVGVGKQWSGARALEALLTVAGELRGPPLQLDTGQLLKIAKRGGVTAVEAVHAWRNALTGAPLNLTPDQVVAIASNGGGKQA
LETVQRLLPVLCQDHGLTPEQVVAIASHDGGKQALETVQRLLPVLCQAHGLTPDQVVAIASNGGGKQALETVQRLLPVLCQAHGLTPAQVVAIASNG
GGKQALETVQRLLPVLCQDHGLTPDQVVAIASNGGGKQALETVQRLLPVLCQDHGLTPEQVVAIASHDGGKQALETVQRLLPVLCQAHGLTPDQVVA
IASHDGGKQALETVQRLLPVLCQAHGLTPAQVVAIASNIGGKQALETVQRLLPVLCQDHGLTPDQVVAIASNIGGKQALETVQRLLPVLCQDHGLTP
EQVVAIASHDGGKQALETVQRLLPVLCQAHGLTPDQVVAIASNGGGKQALETVQRLLPVLCQAHGLTPAQVVAIANNNGGKQALETVQRLLPVLCQD
HGLTPDQVVAIASHDGGKQALETVQRLLPVLCQDHGLTPEQVVAIASNIGGKQALETVQRLLPVLCQAHGLTPDQVVAIASNIGGKQALETVQRLLP
VLCQAHGLTPAQVVAIASNIGGKQALETVQRLLPVLCQDHGLTPEQVVAIASNGGGRPALESIVAQLSRPDPALAALTNDHLVALACLGGRPALDAV
KKGLPHAPALIKRTNRRIPERTSHRVAGSQLVKSELEEKKSELRHKLKYVPHEYIELIEIARNSTQDRILEMKVMEFFMKVYGYRGKHLGGSRKPDG
AIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIG
GEMIKAGTLTLEEVRRKFNNGEINFRS pZMt-101380

(SEQ ID NO: 444)

ctttcctgcgttatccctgattctgtggataaccgtattaccgcctttgagtgagctgataccgctcgccgcag ccgaacgaccgagcgcagcgagtcagtgagcgaggaagcggaagagcgcccaatacgcaaaccgc ctctccccgcgcgttggccgattcattaatgcagctggcacgacaggtttcccgactggaaagcgggcagt gagcgcaacgcaattaatacgcgtaccgctagccaggaagagtttgtagaaacgcaaaaaggccatcc gtcaggatggccttctgcttagtttgatgcctggcagtttatggcgggcgtcctgcccgccaccctccgggcc gttgcttcacaacgttcaaatccgctcccggcggatttgtcctactcaggagagcgttcaccgacaaacaa cagataaaacgaaaggcccagtcttccgactgagcctttcgttttatttgatgcctggcagttccctactctcg cgttaacgctagcatggatgttttcccagtcacgacgttgtaaaacgacggccagtcttaagctcgggcccc aaataatgatttattttgactgatagtgacctgttcgttgcaacaaattgatgagcaatgcttttttataatgccaa ctttgtacaaaaaagcaggctccgaattcgccttttaattaatgcagtgcagcgtgacccggtcgtgccct ctctagagataatgagcattgcatgtctaagttataaaaaattaccacatatttttttgtcacacttgtttgaagtg cagtttatctatctttatacatatatttaaactttactctacgaataatataatctatagtactacaataatatcagtg tttagagaatcatataaatgaacagttagacatggtctaaaggacaattgagtattttgacaacaggactcta cagttttatcttttagtgtgcatgtgttctcctttttttttgcaaatagcttcacctatataatacttcatccatttttattag tacatccatttagggttagggttaatggttttatagactaattttttagtacatctatttattctatttagcctctaa attaagaaaactaaaactctatttttagttttttttatttaataatttagatataaaatagaataaaataaagtgacta -continued

```
aaaattaaacaaatacccttttaagaaattaaaaaaactaaggaaacattttttcttgtttcgagtagataatgcc agcctgttaaacgccgtcgacgagtctaacgacaccaaccagcgaaccagcagcgtcgcgtcgggc caagcgaagcagacggcacggcatctctgtcgctgcctctggaccctctcgagagttccgctccaccgtt ggacttgctccgctgtcggcatccagaaattgcgtggcggagcggcagacgtgagccggcacggcagg cggcctcctcctcctctcacggcaccggcagctacggggattccttcccaccgctccttcgctttcccttc ctcgcccgccgtaataaatagacacccctccacaccctctttccccaacctcgtgttgttcggagcgcac acacacacaaccagatctcccccaaatccacccgtcggcacctccgcttcaaggtacgccgctcgtcct cccccccccccctctctaccttctctagatcggcgttccggtccatggttagggcccggtagttctacttctgt tcatgtttgtgttagatccgtgtttgtgttagatccgtgctgctagcgttcgtacacggatgcgacctgtacgtcag acacgttctgattgctaacttgccagtgtttctctttggggaatcctgggatggctctagccgttccgcagacgg gatcgatttcatgatttttttttgtttcgttgcatagggtttggtttgccttttcctttatttcaatatatgccgtgcacttgt ttgtcgggtcatctttttcatgcttttttttgtcttggttgtgatgatgtggtctggttgggcggtcgttctagatcggagt agaattctgtttcaaactacctggtggatttattaattttggatctgtatgtgtgtgccatacatattcatagttacga attgaagatgatggatggaaatatcgatctaggataggtatacatgttgatgcgggttttactgatgcatataca gagatgcttttttgttcgcttggttgtgatgatgtggtgtggttgggcggtcgttcattcgttctagatcggagtagaa tactgtttcaaactacctggtgtatttattaattttggaactgtatgtgtgtgtcatacatcttcatagttacgagtttta agatggatggaaatatcgatctaggataggtatacatgttgatgtgggttttactgatgcatatacatgatggca tatgcagcatctattcatatgctctaaccttgagtacctatctattataataaacaagtatgttttataattattttgat cttgatatacttggatgatggcatatgcagcagctatatgtggattttttttagccctgccttcatacgctatttatttg cttggtactgtttcttttgtcgatgctcaccctgttgtttggtgttacttctgcaggactagtccagtgtggtggaattc gccatggactacaaagaccatgacggtgattataaagatcatgacatcgattacaaggatgacgatgaca agatggcccccaagaagaagaggaaggtgggcattcacggggtacctatggtggacttgaggacactc ggttattcgcaacagcaacaggagaaaatcaagcctaaggtcaggagcaccgtcgcgcaacaccacg aggcgcttgtggggcatggcttcactcatgcgcatattgtcgcgctttcacagcaccctgcggcgcttggga cggtggctgtcaaataccaagatatgattgcggccctgcccgaagccacgcacgaggcaattgtaggggt cggtaaacagtggtcgggagcgcgagcacttgaggcgctgctgactgtggcgggtgagcttagggggcct ccgctccagctcgacaccgggcagctgctgaagatcgcgaagagaggggggagtaacagcggtagagg cagtgcacgcctggcgcaatgcgctcaccggggcccccttgaacctgaccccagaccaggtagtcgca atcgcgtcgcatgacggggaaagcaagccctggaaaccgtgcaaaggttgttgccggtcctttgtcaag accacggccttacaccggagcaagtcgtggccattgcatcacatgacggtggcaaacaggctcttgaga cggttcagagacttctcccagttctctgtcaagcccacgggctgactcccgatcaagttgtagcgattgcga gcaatggggagggaaacaagcattggagactgtccaacggctccttcccgtgttgtgtcaagcccacgg tttgacgcctgcacaagtggtcgccatcgcctccaatattggcggtaagcaggcgctggaaacagtacag cgcctgctgcctgtactgtgccaggatcatggactcaccccagaccaggtagtcgcaatcgcgtcgcatg acggggaaagcaagccctggaaaccgtgcaaaggttgttgccggtcctttgtcaagaccacggccttac accggatcaagtcgtggccattgcaaataataacggtggcaaacaggctcttgagacggttcagagactt ctcccagttctctgtcaagcccacgggctgactcccgatcaagttgtagcgattgcgagcaacatcggagg gaaacaagcattggagactgtccaacggctccttcccgtgttgtgtcaagcccacggtttgacgcctgcac aagtggtcgccatcgcctcccacgacggcggtaagcaggcgctgaaacagtacagcgcctgctgcct gtactgtgccaggatcatgggctgaccccagaccaggtagtcgcaatcgccaacaataacgggggaaa
```

-continued

```
gcaagccctggaaaccgtgcaaaggttgttgccggtcctttgtcaagaccacggccttacaccggagcaa
gtcgtggccattgcatcaaatatcggtggcaaacaggctcttgagacggttcagagacttctcccagttctct
gtcaagcccacgggctgactcccgatcaagttgtagcgattgcgaataacaatggagggaaacaagcat
tggagactgtccaacggctccttcccgtgttgtgtcaagcccacggtttgacgcctgcacaagtggtcgcca
tcgccaacaacaacggcggtaagcaggcgctggaaacagtacagcgcctgctgcctgtactgtgccag
gatcatggtttgaccccagaccaggtagtcgcaatcgcgtcgaacattgggggaaagcaagccctggaa
accgtgcaaaggttgttgccggtcctttgtcaagaccacggccttacaccggatcaagtcgtggccattgca
ataataacggtggcaaacaggctcttgagacggttcagagacttctcccagttctctgtcaagcccacgg
gctgactcccgatcaagttgtagcgattgcgaataacaatggagggaaacaagcattggagactgtccaa
cggctccttcccgtgttgtgtcaagcccacggtttgacgcctgcacaagtggtcgccatcgcctccaatattg
gcggtaagcaggcgctggaaacagtacagcgcctgctgcctgtactgtgccaggatcatggcctgacac
ccgaacaggtggtcgccattgctagcaacgggggaggacggccagccttggagtccatcgtagcccaat
tgtccaggcccgatcccgcgttggctgcgttaacgaatgaccatctggtggcgttggcatgtcttggtggacg
acccgcgctcgatgcagtcaaaaagggtctgcctcatgctcccgcattgatcaaaagaaccaaccggcg
gattcccgagagaacttcccatcgagtcgcgggatcccagctggttaaatcagaactcgaagaaaaaaa
gagcgagctgcggcataaactcaaatatgtccctcatgagtacatagaactgattgaaatcgcccgcaatt
ccacccaggatcggattcttgaaatgaaagtgatggaattttttatgaaagtttacggctatcgcgggaagca
ccttgggggctcgcggaagccggacggtgctatttacactgtcggttccccgatcgattatggcgtaattgttg
acacgaaagcatattcgggtgggtataatcttcctattggtcaggctgatgagatgcagcggtacgttgaag
agaatcagacgcggaacaagcatattaacccaaatgagtggtggaaggtgtatccatcatcggtcaccg
aatttaagttcttgtttgtgtcgggccactttaaggggaactacaaggcccaacttaccaggttgaatcacata
accaactgtaacggagctgttctgtcagtagaagagctgttgataggcggggaaatgattaaagcaggtac
attaacgttggaggaagtacgccgcaagtttaataacggcgagattaactttagatctgagacctgataaac
aaacacacggtctcctcgagctcgcagatcgttcaacatctggcaataaagtttcttaagattgaatcctgttg
ccggtcttgcgatgattatcatataatttctgttgaattacgttaagcatgtaataattaacatgtaatgcatgacg
ttatttatgagatgggtttttatgattagagtcccgcaattatacatttaatacgcgatagaaaacaaaatatagc
gcgcaaactaggataaattatcgcgcgcggtgtcatctatgttactagatccgataagcttaagggcgaatt
cgacccagcttttcttgtacaaagttggcattataaaaaataattgctcatcaatttgttgcaacgaacaggtca
ctatcagtcaaaataaaatcattatttgccatccagctgatatcccctatagtgagtcgtattacatggtcatag
ctgtttcctggcagctctggcccgtgtctcaaaatctctgatgttacattgcacaagataaaaatatatcatcat
gcctcctctagaccagccaggacagaaatgcctcgacttcgctgctgcccaaggttgccgggtgacgca
caccgtggaaacggatgaaggcacgaacccagtggacataagcctgttcggttcgtaagctgtaatgca
agtagcgtatgcgctcacgcaactggtccagaaccttgaccgaacgcagcggtggtaacggcgcagtgg
cggttttcatggcttgttatgactgttttttttggggtacagtctatgcctcgggcatccaagcagcaagcgcgtta
cgccgtgggtcgatgtttgatgttatggagcagcaacgatgttacgcagcagggcagtcgccctaaaacaa
agttaaacatcatgagggaagcggtgatcgccgaagtatcgactcaactatcagaggtagttggcgtcatc
gagcgccatctcgaaccgacgttgctggccgtacatttgtacggctccgcagtggatggcggcctgaagc
cacacagtgatattgatttgctggttacggtgaccgtaaggcttgatgaaacaacgcggcgagctttgatca
acgaccttttggaaacttcggcttcccctggagagagcgagattctccgcgctgtagaagtcaccattgttgt
gcacgacgacatcattccgtggcgttatccagctaagcgcgaactgcaatttggagaatggcagcgcaat
gacattcttgcaggtatcttcgagccagccacgatcgacattgatctggctatcttgctgacaaaagcaaga
```

-continued

```
gaacatagcgttgccttggtaggtccagcggcggaggaactctttgatccggttcctgaacaggatctatttg
aggcgctaaatgaaaccttaacgctatggaactcgccgcccgactgggctggcgatgagcgaaatgtagt
gcttacgttgtcccgcatttggtacagcgcagtaaccggcaaaatcgcgccgaaggatgtcgctgccgact
gggcaatggagcgcctgccggcccagtatcagcccgtcatacttgaagctagacaggcttatcttggaca
agaagaagatcgcttggcctcgcgcgcagatcagttggaagaatttgtccactacgtgaaaggcgagatc
accaaggtagtcggcaaataaccctcgagccacccatgaccaaaatcccttaacgtgagttacgcgtcgt
tccactgagcgtcagacccgtagaaaagatcaaaggatcttcttgagatccttttttctgcgcgtaatctgct
gcttgcaaacaaaaaaaccaccgctaccagcggtggtttgtttgccggatcaagagctaccaactcttttc
cgaaggtaactggcttcagcagagcgcagataccaaatactgtccttctagtgtagccgtagttaggccac
cacttcaagaactctgtagcaccgcctacatacctcgctctgctaatcctgttaccagtggctgctgccagtg
gcgataagtcgtgtcttaccgggttggactcaagacgatagttaccggataaggcgcagcggtcgggctga
acgggggttcgtgcacacagcccagcttggagcgaacgacctacaccgaactgagatacctacagcg
tgagcattgagaaagcgccacgcttcccgaagggagaaaggcggacaggtatccggtaagcggcagg
gtcggaacaggagagcgcacgagggagcttccaggggggaaacgcctggtatctttatagtcctgtcgggtt
tcgccacctctgacttgagcgtcgattttttgtgatgctcgtcagggggcggagcctatggaaaaacgccag
caacgcggccttttttacggttcctggccttttgctggccttttgctcacatgtt
```

---

SEQUENCE LISTING (555 sequences)

SEQ ID NO: 1 - protein, 34 aa, Xanthomonas campestris
LDTGQLLKIAKRGGVTAVEAVHAWRNALTGAPLN

SEQ ID NO: 2 - protein, 34 aa, Xanthomonas campestris
LTPEQVVAIASNIGGKQALETVQALLPVLCQAHG

SEQ ID NO: 3 - protein, 34 aa, Xanthomonas campestris
LTPDQVVAIASNGGGKQALETVQRLLPVLCQAHG

SEQ ID NO: 4 - protein, 34 aa, Xanthomonas campestris
LTPEQVVAIASNIGGKQALETVQRLLPVLCQAHG

SEQ ID NO: 5 - protein, 34 aa, Xanthomonas campestris; identical to SEQ ID NO: 4

SEQ ID NO: 6 - protein, 34 aa, Xanthomonas campestris
LTPEQVVAIASNGGGKQALETVQRLLPVLCQAHG

SEQ ID NO: 7 - protein, 34 aa, Artificial Sequence
  Description of Artificial Sequence: Synthetic polypeptide
LTPEQVVAIASHDGGKQALETVQRLLPVLCQAHG

SEQ ID NO: 8 - protein, 34 aa, Artificial Sequence
  Description of Artificial Sequence: Synthetic polypeptide
LTPEQVVAIASNNGGKQALETVQRLLPVLCQAHG

SEQ ID NO: 9 - protein, 34 aa, Xanthomonas oryzae
LTPDQVVAIASNIGGNQALETVQRLLPVLCQAHG

SEQ ID NO: 10 - protein, 34 aa, Xanthomonas oryzae
LTPDQVVAIASHGGGKQALETVQRLLPVLCQAHG

SEQ ID NO: 11 - protein, 34 aa, Xanthomonas oryzae
LTPDQVVAIASNIGGKQALATVQRLLPVLCQDHG

SEQ ID NO: 12 - protein, 34 aa, Xanthomonas oryzae
LTPDQVVAIASHGGGKQALETVQRLLPVLCQDHG

SEQ ID NO: 13 - protein, 34 aa, Xanthomonas oryzae
LTPDQVVAIASNIGGKQALETVQRLLPVLCQDHG

SEQ ID NO: 14 - protein, 34 aa, Xanthomonas oryzae; identical to SEQ ID NO: 13

SEQ ID NO: 15 - protein, 34 aa, Xanthomonas oryzae
LTPDQVVAIASNNGGKQALETVQRLLPVLCQTHG

SEQ ID NO: 16 - protein, 34 aa, Xanthomonas oryzae
LTPDQVVAIANHDGGKQALETVQRLLPVLCQDHG

SEQ ID NO: 17 - protein, 34 aa, Xanthomonas oryzae
LTPDQVVAIASNIGGKQALATVQRLLPVLCQAHG

SEQ ID NO: 18 - protein, 34 aa, Xanthomonas oryzae
LTPDQVVAIASHDGGKQALETVQRLLPVLCQDHG

SEQ ID NO: 19 - protein, 34 aa, Xanthomonas oryzae
LTPDQVVAIASNNGGKQALETVQRLLPVLCQDHG

SEQ ID NO: 20 - protein, 34 aa, Xanthomonas oryzae
LTPAQVVAIANHGGGKQALETVQRLLPVLCQDHG

SEQ ID NO: 21 - protein, 34 aa, Xanthomonas oryzae
LTPVQVVAIASNSGGKQALETVQRLLPVLCQDHG

SEQ ID NO: 22 - protein, 34 aa, Xanthomonas oryzae
LTPVQVVAIASNGGGKQALATVQRLLPVLCQDHG

SEQ ID NO: 23 - protein, 34 aa, Xanthomonas oryzae
LTPVQVVAIASHDGGKQALETVQRLLPVLCQDHG

SEQ ID NO: 24 - protein, 34 aa, Xanthomonas oryzae
LTPDQVVAIASNGGKQALESIVAQLSRPDPALAA

SEQ ID NO: 25 - protein, 35 aa, Ralstonia solanacearum
LTPQQVVAIASNTGGKRALEAVCVQLPVLRAAPYR

SEQ ID NO: 26 - protein, 35 aa, Ralstonia solanacearum
LSTEQVVAIASNKGGKQALEAVKAHLLDLLGAPYV

SEQ ID NO: 27 - protein, 35 aa, Ralstonia solanacearum
LDTEQVVAIASHNGGKQALEAVKADLLDLRGAPYA

SEQ ID NO: 28 - protein, 35 aa, Ralstonia solanacearum
LSTEQVVAIASHNGGKQALEAVKADLLDLRGAPYA

SEQ ID NO: 29 - protein, 35 aa, Ralstonia solanacearum
LSTEQVVAIASHNGGKQALEAVKAQLLDLRGAPYA

SEQ ID NO: 30 - protein, 35 aa, Ralstonia solanacearum
LSTAQVVAIASHNGGKQALEAVKAQLLDLRGAPYA

SEQ ID NO: 31 - protein, 35 aa, Ralstonia solanacearum
LSTAQVVAIASNGGGKQALEGIGEQLLKLRTAPYG

SEQ ID NO: 32 - protein, 35 aa, Ralstonia solanacearum
LSTEQVVAIASSHGGKQALEAVRALFPDLRAAPYA

SEQ ID NO: 33 - protein, 35 aa, Ralstonia solanacearum
LSTAQLVAIASNPGGKQALEAVRALFRELRAAPYA

SEQ ID NO: 34 - protein, 35 aa, Ralstonia solanacearum
LSTEQVVAIASNHGGKQALEAVRALFRELRAAPYA

SEQ ID NO: 35 - protein, 35 aa, Ralstonia solanacearum
LSTEQVVAIASNHGGKQALEAVRALFRGLRAAPYG

SEQ ID NO: 36 - protein, 35 aa, Ralstonia solanacearum
LSTAQVVAIASSNGGKQALEAVWALLPVLRATPYD

SEQ ID NO: 37 - protein, 35 aa, Ralstonia solanacearum
LNTAQVVAIASHYGGKPALEAVWAKLPVLRGVPYA

SEQ ID NO: 38 - protein, 33 aa, Ralstonia solanacearum
LSTAQVVAIACISGQQALEAIEAHMPTLRQAPH

SEQ ID NO: 39 - protein, 35 aa, Ralstonia solanacearum
LSTAQLVAIASNPGGKQALEAVRAPFREVRAAPYA

SEQ ID NO: 40 - protein, 35 aa, Ralstonia solanacearum
LSPEQVVAIASNHGGKQALEAVRALFRGLRAAPYG

SEQ ID NO: 41 - protein, 35 aa, Ralstonia solanacearum; identical to SEQ ID NO: 36

SEQ ID NO: 42 - protein, 35 aa, Ralstonia solanacearum
LSTAQVVAIASHDGGKPALEAVWAKLPVLRGAPYA

SEQ ID NO: 43 - protein, 33 aa, Ralstonia solanacearum; identical to SEQ ID NO: 38

SEQ ID NO: 44 - protein, 494 aa, Xanthomonas campestris
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPDQVVAIASNGGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNGGGKQALETVQRLLPVLCQAHGLI

SEQ ID NO: 45 - protein, 1102 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEAGELRGPPLQLDTGQLLKIAKRGGVTAVEAVHAWRNALTGAPLNLTPDQVVAIASNIGGNQALETVQRLLPVLCQAHGLTPDQVVAIASHGGGKQALETVQRLLPVLCQAHGLTPDQVVAIASNIGGKQALATVQRLLPVLCQDHGLTPDQVVAIASHGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQTHGLTPDQVVAIANHDGGKQALETVQRLLPVLCQDHGLTPDQVVAIASNIGGKQALATVQRLLPVLCQAHGLTPDQVVAIASHDGGKQALETVQRLLPVLCQDHGLTPDQVVAIASNNGGKQALETVQRLLPVLCQDHGLTPAQVVAIANHGGGKQALETVQRLLPVLCQDHGLTPVQVVAIASNSGGKQALETVQRLLPVLCQDHGLTPVQVVAIASNGGGKQALATVQRLLPVLCQDHGLTPVQVVAIASHDGGKQALETVQRLLPVLCQDHGLTPDQVVAIASNGGKQALESIVAQLSRPDPALAALTNDHLVALACLGGRPALDAVKKGLPHAPELIRRINRRIPERTSHRVADLAHVVRVLGFFQSHSHPAQAFDDAMTQFGMSRHGLAQLFRRVGVTELEARYGTLPPASQRWDRILQASGMKRVKPSPTSAQTPDQASLHAFADSLERDLDAPSPMHEGDQTRASSRKRSRSDRAVTGPSTQQSFEVRVPEQQDALHLPLSWRVKRPRTRIGGGLPDPGTPIAADLAASSTVMWEQDAAPFAGAADDFPAFNEEELAWLMELLPQSGSVGGTI

SEQ ID NO: 46 - protein, 174 aa, Ralstonia solanacearum
LSTAQLVAIASNPGGKQALEAVRAPFREVRAAPYALSPEQVVAIASNHGGKQALEAVRALFRGLRAAPYGLSTAQVVAIASSNGGKQALEAVWALLPVLRATPYDLSTAQVVAIASHDGGKPALEAVWAKLPVLRGAPYALSTAQVVAIACISGQQALEAIEAHMPTLRQAPHS

SEQ ID NO: 47 - protein, 509 aa, Ralstonia solanacearum
  NON_CONS (245)..(246)
LTPQQVVAIASNTGGKRALEAVCVQLPVLRAAPYRLSTEQVVAIASNKGGKQALEAVKAHLLDLLGAPYVLDTEQVVAIASHNGGKQALEAVKADLLDLRGAPYALSTEQVVAIASHNGGKQALEAVKADLLDLRGAPYALSTEQVVAIASHNGGKQALEAVKAQLLDLRGAPYALSTAQVVAIASHNGGKQALEAVKAQLLDLRGAPYALSTAQVVAIASNGGGKQALEGIGEQLLKLRTAPYGLSTEQVVAIASSHGGKQALEAVRALFPDLRAAPYALSTAQLVAIASNPGGKQALEAVRALFRELRAAPYALSTEQVVAIASNHGGKQALEAVRALFRELRAAPYALSTEQVVAIASNHGGKQALEAVRALFRGLRAAPYGLSTAQVVAIASSNGGKQALEAVWALLPVLRATPYDLNTAQVVAIASHYGGKPALEAVWAKLPVLRGVPYALSTAQVVAIACISGQQALEAIEAHMPTLRQAPHGLSPERVAAIACIGGRSAVEA

SEQ ID NO: 48 - protein, 5 aa, Artificial Sequence
  Description of Artificial Sequence: Synthetic peptide
TGEKP

SEQ ID NO: 49 - protein, 6 aa, Artificial Sequence
  Description of Artificial Sequence: Synthetic peptide
TGGQRP

SEQ ID NO: 50 - protein, 5 aa, Artificial Sequence
  Description of Artificial Sequence: Synthetic peptide
TGQKP

SEQ ID NO: 51 - protein, 6 aa, Artificial Sequence
  Description of Artificial Sequence: Synthetic peptide
TGSQKP

SEQ ID NO: 52 - DNA, 31 bp, Artificial Sequence
  Description of Artificial Sequence: Synthetic primer
acgtggattcatggtggatctacgcacgctc

SEQ ID NO: 53 - DNA, 33 bp, Artificial Sequence
  Description of Artificial Sequence: Synthetic primer
tacgtccgcggtcctgaggcaatagctccatca

SEQ ID NO: 54 - DNA, 14 bp, Artificial Sequence
  Description of Artificial Sequence: Synthetic oligonucleotide
tataaataccttct

SEQ ID NO: 55 - DNA, 66 bp, Artificial Sequence
  Description of Artificial Sequence: Synthetic oligonucleotide
  modified_base (25)..(42): a, c, t, g, unknown or other
cagggatccatgcactgtacgtttnnnnnnnnnnnnnnnnnnaaaccacttgactgcggatcctgg

SEQ ID NO: 56 - DNA, 10 bp, Artificial Sequence
  Description of Artificial Sequence: Synthetic oligonucleotide
  modified_base (3)..(3): a, c, t, g, unknown or other
tanaaacctt

SEQ ID NO: 57 - DNA, 17 bp, Artificial Sequence
  Description of Artificial Sequence: Synthetic oligonucleotide
tacacatctttaacact

SEQ ID NO: 58 - DNA, 18 bp, Artificial Sequence
  Description of Artificial Sequence: Synthetic oligonucleotide
ggagccatctggccgggt

SEQ ID NO: 59 - DNA, 70 bp, Artificial Sequence
  Description of Artificial Sequence: Synthetic oligonucleotide
  modified_base (25)..(46): a, c, t, g, unknown or other
cagggatccatgcactgtacgaaannnnnnnnnnnnnnnnnnnnnntttccacttgactgcggatcctgg

SEQ ID NO: 60 - DNA, 69 bp, Artificial Sequence
  Description of Artificial Sequence: Synthetic oligonucleotide
  modified_base (25)..(45): a, c, t, g, unknown or other
cagggatccatgcactgtacgtttnnnnnnnnnnnnnnnnnnnnnaaaccacttgactgcggatcctgg

SEQ ID NO: 61 - DNA, 71 bp, Artificial Sequence
  Description of Artificial Sequence: Synthetic oligonucleotide
  modified_base (25)..(47): a, c, t, g, unknown or other
cagggatccatgcactgtacgtttnnnnnnnnnnnnnnnnnnnnnnnaaaccacttgactgcggatcctgg

SEQ ID NO: 62 - DNA, 78 bp, Artificial Sequence
  Description of Artificial Sequence: Synthetic oligonucleotide
  modified_base (25)..(54): a, c, t, g, unknown or other
cagggatccatgcactgtacgcccnnnnnnnnnnnnnnnnnnnnnnnnnnnnnngggccacttgactgcggatcctgg

SEQ ID NO: 63 - protein, 34 aa, Artificial Sequence
  Description of Artificial Sequence: Synthetic polypeptide
LTPQQVVAIASNNGGKQALETVQRLLPVLCQAHG

SEQ ID NO: 64 - protein, 34 aa, Artificial Sequence
  Description of Artificial Sequence: Synthetic polypeptide
LTPQQVVAIASNIGGKQALETVQRLLPVLCQAHG

SEQ ID NO: 65 - protein, 34 aa, Artificial Sequence
  Description of Artificial Sequence: Synthetic polypeptide
LTPEQVVAIASHDGGKQALETVQALLPVLCQAHG

SEQ ID NO: 66 - protein, 34 aa, Artificial Sequence
  Description of Artificial Sequence: Synthetic polypeptide
LTPQQVVAIASNGGGKQALETVQRLLPVLCQAHG

SEQ ID NO: 67 - protein, 34 aa, Artificial Sequence
  Description of Artificial Sequence: Synthetic polypeptide
LTPEQVVAIASNNGGKQALETVQALLPVLCQAHG

SEQ ID NO: 68 - protein, 34 aa, Artificial Sequence
  Description of Artificial Sequence: Synthetic polypeptide
LTPEQVVAIASNKGGKQALETVQRLLPVLCQAHG

SEQ ID NO: 69 - protein, 34 aa, Artificial Sequence
  Description of Artificial Sequence: Synthetic polypeptide
LTPQQVVAIASNKGGRPALETVQRLLPVLCQAHG

SEQ ID NO: 70 - protein, 35 aa, Artificial Sequence
  Description of Artificial Sequence: Synthetic polypeptide
LTPQQVVAIASNGGGRPALESIVAQLSRPDPALAA

SEQ ID NO: 71 - protein, 2 aa, Artificial Sequence
  Description of Artificial Sequence: Synthetic peptide
GS

SEQ ID NO: 72 - protein, 8 aa, Artificial Sequence
  Description of Artificial Sequence: Synthetic peptide
GGSGGSGS

SEQ ID NO: 73 - protein, 77 aa, Xanthomonas campestris
MVDLRTLGYSQQQQEKIKPKVRSTVAQHHEALVGHGFTHAHIVALSQHPAALGTVAVKYQDMIAALPEATHEAIVGV

SEQ ID NO: 74 - protein, 35 aa, Artificial Sequence
  Description of Artificial Sequence: Synthetic polypeptide
LSTAQVVAIASHDGGKQALEAVRAQLLVLRAAPYA

SEQ ID NO: 75 - protein, 34 aa, Artificial Sequence
  Description of Artificial Sequence: Synthetic polypeptide
LTPDAVVAIASHDGGKQALETVQRLLPVLCQDHG

SEQ ID NO: 76 - protein, 34 aa, Artificial Sequence
  Description of Artificial Sequence: Synthetic polypeptide
LTPDQAVAIASHDGGKQALETVQRLLPVLCQDHG

SEQ ID NO: 77 - DNA, 68 bp, Artificial Sequence
  Description of Artificial Sequence: Synthetic oligonucleotide
gcacgtggcggagccatctggccgggttggctggttataaccgcgcagattctgttcaccgcgcgata

SEQ ID NO: 78 - DNA, 68 bp, Artificial Sequence
  Description of Artificial Sequence: Synthetic oligonucleotide
gcacgtggcggagccatctggccgggttggctggttatgaagggggaggatcgatcggacgcgcgata

SEQ ID NO: 79 - DNA, 68 bp, Artificial Sequence
  Description of Artificial Sequence: Synthetic oligonucleotide
gcacgtggccatggactcctcccccttcagctggttataaccgcgcagattctgttcaccgcgcgata

SEQ ID NO: 80 - DNA, 20 bp, Artificial Sequence
  Description of Artificial Sequence: Synthetic primer
gaaggggttaaggcgctgag

SEQ ID NO: 81 - DNA, 20 bp, Artificial Sequence
  Description of Artificial Sequence: Synthetic primer
agggacgtcgacatgaagag

SEQ ID NO: 82 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
tggcgtacggatccaagcttcgtcgacctagcc

SEQ ID NO: 83 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
gccaggctaggtcgacgaagcttggatccgtac

SEQ ID NO: 84 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
ggctgtacggatccaagcttcgtcgacctagcc

SEQ ID NO: 85 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
agccggctaggtcgacgaagcttggatccgtac

SEQ ID NO: 86 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
gctggtacggatccaagcttcgtcgacctagcc

SEQ ID NO: 87 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
cagcggctaggtcgacgaagcttggatccgtac

SEQ ID NO: 88 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
ctgggtacggatccaagcttcgtcgacctagcc

SEQ ID NO: 89 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
ccagggctaggtcgacgaagcttggatccgtac

SEQ ID NO: 90 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
tggtgtacggatccaagcttcgtcgacctagcc

SEQ ID NO: 91 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
accaggctaggtcgacgaagcttggatccgtac

SEQ ID NO: 92 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
ggttgtacggatccaagcttcgtcgacctagcc

SEQ ID NO: 93 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
aaccggctaggtcgacgaagcttggatccgtac

SEQ ID NO: 94 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
gttagtacggatccaagcttcgtcgacctagcc

SEQ ID NO: 95 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
taacggctaggtcgacgaagcttggatccgtac

SEQ ID NO: 96 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
ttatgtacggatccaagcttcgtcgacctagcc

SEQ ID NO: 97 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
ataaggctaggtcgacgaagcttggatccgtac

SEQ ID NO: 98 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
tatagtacggatccaagcttcgtcgacctagcc

SEQ ID NO: 99 - DNA, 33 bp, Artificial Sequence
  Description of Artificial Sequence: Synthetic primer
  modified_base (1)..(2): Phosphorothioate linkage
  modified_base (2)..(3): Phosphorothioate linkage
tataggctaggtcgacgaagcttggatccgtac

SEQ ID NO: 100 - DNA, 21 bp, Artificial Sequence
  Description of Artificial Sequence: Synthetic primer
ggatccaagcttcgtcgacct

SEQ ID NO: 101 - DNA, 20 bp, Artificial Sequence
  Description of Artificial Sequence: Synthetic primer
cagcgcaaactttggggaag

SEQ ID NO: 102 - DNA, 12 bp, Artificial Sequence
  Description of Artificial Sequence: Synthetic oligonucleotide
  modified_base (7)..(12): a, c, t, g, unknown or other
ggtctcnnnnnn

SEQ ID NO: 103 - DNA, 12 bp, Artificial Sequence
  Description of Artificial Sequence: Synthetic oligonucleotide
  modified_base (7)..(12): a, c, t, g, unknown or other
ggtctcnnnnnn

SEQ ID NO: 104 - DNA, 12 bp, Artificial Sequence
  Description of Artificial Sequence: Synthetic oligonucleotide
  modified_base (7)..(12): a, c, t, g, unknown or other
ccagagnnnnnn

SEQ ID NO: 105 - DNA, 12 bp, Artificial Sequence
  Description of Artificial Sequence: Synthetic oligonucleotide
  modified_base (7)..(12): a, c, t, g, unknown or other
ccagagnnnnnn

SEQ ID NO: 106 - DNA, 34 bp, Artificial Sequence
  Description of Artificial Sequence: Synthetic primer
ggatccggatggtctcaacctgaccccagaccag

SEQ ID NO: 107 - DNA, 39 bp, Artificial Sequence
  Description of Artificial Sequence: Synthetic primer
gagggatgcgggtctctgagtccatgatcctggcacagt

SEQ ID NO: 108 - DNA, 37 bp, Artificial Sequence
  Description of Artificial Sequence: Synthetic primer
ggatccggatgggtctcaactcaccccagaccaggta

SEQ ID NO: 109 - DNA, 39 bp, Artificial Sequence
  Description of Artificial Sequence: Synthetic primer
gagggatgcgggtctctcagcccatgatcctggcacagt

SEQ ID NO: 110 - DNA, 34 bp, Artificial Sequence
  Description of Artificial Sequence: Synthetic primer
ggatccggatgggtctcagctgaccccagaccag

SEQ ID NO: 111 - DNA, 39 bp, Artificial Sequence
  Description of Artificial Sequence: Synthetic primer
gagggatgcgggtctctcaaaccatgatcctggcacagt

SEQ ID NO: 112 - DNA, 37 bp, Artificial Sequence
  Description of Artificial Sequence: Synthetic primer
ggatccggatgggtctcatttgaccccagaccaggta

SEQ ID NO: 113 - DNA, 33 bp, Artificial Sequence
  Description of Artificial Sequence: Synthetic primer
ctcgagggatggtctcctgtcaggccatgatcc

SEQ ID NO: 114 - DNA, 13 bp, Homo sapiens
cttcattacacct

SEQ ID NO: 115 - DNA, 17 bp, Homo sapiens
tcattacacctgcagct

SEQ ID NO: 116 - DNA, 14 bp, Homo sapiens
acacctgcagctct

SEQ ID NO: 117 - DNA, 17 bp, Homo sapiens
acacctgcagctctcat

SEQ ID NO: 118 - DNA, 79 bp, Homo sapiens
aaaaagaaggtcttcattacacctgcagctctcattttccatacagtcagtatcaattctggaagaatttccagacatt

SEQ ID NO: 119 - DNA, 79 bp, Homo sapiens
aatgtctggaaattcttccagaattgatactgactgtatggaaaatgagagctgcaggtgtaatgaagaccttcttttt

SEQ ID NO: 120 - DNA, 14 bp, Homo sapiens
gatactgactgtat

SEQ ID NO: 121 - DNA, 13 bp, Homo sapiens
tgatactgactgt

SEQ ID NO: 122 - DNA, 17 bp, Homo sapiens
cttccagaattgatact

SEQ ID NO: 123 - DNA, 15 bp, Homo sapiens
tcttccagaattgat

SEQ ID NO: 124 - protein, 5 aa, Artificial Sequence
  Description of Artificial Sequence: Synthetic peptide
GGGGS

SEQ ID NO: 125 - protein, 9 aa, Unknown
  Description of Unknown: "LAGLIDADG" motif sequence
LAGLIDADG

SEQ ID NO: 126 - DNA, 72 bp, Artificial Sequence
  Description of Artificial Sequence: Synthetic oligonucleotide
  modified_base (24)..(49): a, c, t, g, unknown or other
cagggatccatgcactgtacgttnnnnnnnnnnnnnnnnnnnnnnnnnnaaccacttgactgcggatcctgg

SEQ ID NO: 127 - protein, 4 aa, Artificial Sequence
  Description of Artificial Sequence: Synthetic peptide
GGGS

SEQ ID NO: 128 - DNA, 68 bp, Artificial Sequence
  Description of Artificial Sequence: Synthetic oligonucleotide
atcgcgcggtgaacagaatctgcgcggttataaccagccaacccggccagatggctccgccacgtgca

SEQ ID NO: 129 - DNA, 68 bp, Artificial Sequence
  Description of Artificial Sequence: Synthetic oligonucleotide
atcgcgcgtccgatcgatcctcccccttcataaccagccaacccggccagatggctccgccacgtgca

SEQ ID NO: 130 - DNA, 68 bp, Artificial Sequence
  Description of Artificial Sequence: Synthetic oligonucleotide
atcgcgcggtgaacagaatctgcgcggttataaccagctgaagggggaggagtccatggccacgtgca

SEQ ID NO: 131 - DNA, 246 bp, Artificial Sequence
  Description of Artificial Sequence: Synthetic polynucleotide
ctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggc

SEQ ID NO: 132 - protein, 332 aa, Xanthomonas sp.
LTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRAPEQRDALHLPLSWRVKRPRTSIGGGLPDPGTPTAADLAASSTVMREQDEDPFAGAADDFPAFNEEELAWLMELLPQ

SEQ ID NO: 133 - DNA, 92 bp, Homo sapiens
tcatctttggttttgtgggcaacatgctggtcatcctcatcctgataaactgcaaaaggctgaagagcatgactgacatctacctgctcaac

SEQ ID NO: 134 - DNA, 138 bp, Artificial Sequence
  Description of Artificial Sequence: Synthetic polynucleotide
tcatctttggttttgtgggcaacatgctggtcatcctcatctagatcagtgagtatgccctgatggcgtctggactggatgcctcgtctagaaaactgcaaaaggctgaagagcatgactgacatctacctgctcaac

SEQ ID NO: 135 - protein, 840 aa, Artificial Sequence
  Description of Artificial Sequence: Synthetic polypeptide
VDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRAPEQRDALHLPLSWRVKRPRTSIGGGLPDPGTPTAADLAASSTVMREQDEDPFAGAADDFPAFNEEELAWLMELLPQ

SEQ ID NO: 136 - DNA, 253 bp, Artificial Sequence
  Description of Artificial Sequence: Synthetic polynucleotide
ggtaccgagctcttacgcgtgctagcccgggctcgagatctgcgatctgcatctcaattagtcagcaaccatagtcccgcccctaactccgcccatcccgcccctaactccgcccagttccgcccattctccgccccatcgctgactaattttttttatttatgcagaggccgaggccgcctcggcctctgagctattccagaagtagtgaggaggcttttttggaggcctaggcttttgcaaaaagcttggc

SEQ ID NO: 137 - DNA, 57 bp, Artificial Sequence
  Description of Artificial Sequence: Synthetic oligonucleotide
ctagtataaataccttctgccttactagtataaataccttctgccttgctagctcga

SEQ ID NO: 138 - DNA, 72 bp, Artificial Sequence
  Description of Artificial Sequence: Synthetic oligonucleotide
gagcggagccatctggccgggttggctggttataaccgcgcagattctgttcacgggactcagagttgaagc

SEQ ID NO: 139 - DNA, 86 bp, Homo sapiens
tcaactctgagtcccgtgaacagaatctgcgcggttataaccagccaacccggccagatggctccgcgctcagcgccttaacccct

SEQ ID NO: 140 - DNA, 86 bp, Homo sapiens
aggggttaaggcgctgagcgcggagccatctggccgggttggctggttataaccgcgcagattctgttcacgggactcagagttga

SEQ ID NO: 141 - DNA, 83 bp, Homo sapiens
tcaactctgagtcccgtgaacagaatctgcgcggttataaccagccaacccggccagatggctccgcgctcagcgccttaacc

SEQ ID NO: 142 - DNA, 46 bp, Artificial Sequence
  Description of Artificial Sequence: Synthetic oligonucleotide
tcaactctgagtcccgtgaacagaatctgcgcggttataacaacca

SEQ ID NO: 143 - DNA, 46 bp, Artificial Sequence
  Description of Artificial Sequence: Synthetic oligonucleotide
tcaactctgagtcccgtgaacagaatctgcgcggttatatataacc

SEQ ID NO: 144 - DNA, 46 bp, Artificial Sequence
  Description of Artificial Sequence: Synthetic oligonucleotide
tcaactctgagtcccgtgaacagaatctgcgcggttataagccaac

SEQ ID NO: 145 - DNA, 46 bp, Artificial Sequence
  Description of Artificial Sequence: Synthetic oligonucleotide
tcaactctgagtcccgtgaacagaatctgcgcggttatcagccaac

SEQ ID NO: 146 - DNA, 46 bp, Artificial Sequence
  Description of Artificial Sequence: Synthetic oligonucleotide
tcaactctgagtcccgtgaacagaatctgcgcggttaccagccaac

SEQ ID NO: 147 - DNA, 46 bp, Artificial Sequence
  Description of Artificial Sequence: Synthetic oligonucleotide
tcaactctgagtcccgtgaacagaatctgcgcggttccagccaacc

SEQ ID NO: 148 - DNA, 46 bp, Artificial Sequence
  Description of Artificial Sequence: Synthetic oligonucleotide
tcaactctgagtcccgtgaacagaatctgcgcggttatgccaaccc

SEQ ID NO: 149 - DNA, 46 bp, Artificial Sequence
  Description of Artificial Sequence: Synthetic oligonucleotide
tcaactctgagtcccgtgaacagaatctgcgcggccaacccggcca

SEQ ID NO: 150 - DNA, 46 bp, Artificial Sequence
  Description of Artificial Sequence: Synthetic oligonucleotide
tcaactctgagtcccgtgaacagaatctgcgcggttaacccggcca

SEQ ID NO: 151 - DNA, 46 bp, Artificial Sequence
  Description of Artificial Sequence: Synthetic oligonucleotide
tcaactctgagtcccgtgaacagaatctgcgcggttataacggcca

SEQ ID NO: 152 - DNA, 46 bp, Artificial Sequence
  Description of Artificial Sequence: Synthetic oligonucleotide
tcaactctgagtcccgtgaacagaatctgcgcggtcaacccggcca

SEQ ID NO: 153 - DNA, 46 bp, Artificial Sequence
  Description of Artificial Sequence: Synthetic oligonucleotide
tcaactctgagtcccgtgaacagaatctgcgcagccaacccggcca

SEQ ID NO: 154 - DNA, 46 bp, Artificial Sequence
  Description of Artificial Sequence: Synthetic oligonucleotide
tcaactctgagtcccgtgaacagaatctgcccagccaacccggcca

SEQ ID NO: 155 - DNA, 46 bp, Artificial Sequence
  Description of Artificial Sequence: Synthetic oligonucleotide
tcaactctgagtcccgtgaacagaatctgcgccaacccggccagat

SEQ ID NO: 156 - DNA, 46 bp, Artificial Sequence
  Description of Artificial Sequence: Synthetic oligonucleotide
tcaactctgagtcccgtgaacagaatctgcgcgcccggccagatgg

SEQ ID NO: 157 - DNA, 46 bp, Artificial Sequence
  Description of Artificial Sequence: Synthetic oligonucleotide
tcaactctgagtcccgtgaacagaatctgcgcccggccagatggct

SEQ ID NO: 158 - DNA, 46 bp, Artificial Sequence
  Description of Artificial Sequence: Synthetic oligonucleotide
tcaactctgagtcccgtgaacagaatctgcgcggccagatggctcc

SEQ ID NO: 159 - DNA, 46 bp, Artificial Sequence
  Description of Artificial Sequence: Synthetic oligonucleotide
tcaactctgagtcccgtgaacagaatctgcgcggtcagatggctcc

SEQ ID NO: 160 - DNA, 46 bp, Artificial Sequence
  Description of Artificial Sequence: Synthetic oligonucleotide
tcaactctgagtcccgtgaacagaatctgcgcggttataaggctcc

SEQ ID NO: 161 - DNA, 46 bp, Artificial Sequence
  Description of Artificial Sequence: Synthetic oligonucleotide
tcaactctgagtcccgtgaacagaatctgcgcggttatatggctcc

SEQ ID NO: 162 - DNA, 46 bp, Artificial Sequence
  Description of Artificial Sequence: Synthetic oligonucleotide
tcaactctgagtcccgtgaacagaatctgcccggccagatggctcc

SEQ ID NO: 163 - DNA, 46 bp, Artificial Sequence
  Description of Artificial Sequence: Synthetic oligonucleotide
tcaactctgagtcccgtgaacagaatcaacccggccagatggctcc

SEQ ID NO: 164 - DNA, 46 bp, Artificial Sequence
  Description of Artificial Sequence: Synthetic oligonucleotide
tcaactctgagtcccgtgaacagaaccaacccggccagatggctcc

SEQ ID NO: 165 - DNA, 46 bp, Artificial Sequence
  Description of Artificial Sequence: Synthetic oligonucleotide
tcaactctgagtcccgtgaacagaatctgcgcgccagatggctccg

SEQ ID NO: 166 - DNA, 46 bp, Artificial Sequence
  Description of Artificial Sequence: Synthetic oligonucleotide
tcaactctgagtcccgtgaacagaatctgcgccagatggctccgcg

SEQ ID NO: 167 - DNA, 46 bp, Artificial Sequence
  Description of Artificial Sequence: Synthetic oligonucleotide
tcaactctgagtcccgtgaacagaatctgcgcggatggctccgcgc

SEQ ID NO: 168 - DNA, 46 bp, Artificial Sequence
  Description of Artificial Sequence: Synthetic oligonucleotide
tcaactctgagtcccgtgaacagaatctgcgcggttaccgcgctca

SEQ ID NO: 169 - DNA, 46 bp, Artificial Sequence
  Description of Artificial Sequence: Synthetic oligonucleotide
tcaactctgagtcccgtgaacagaatctgcgcggttccgcgctcag

SEQ ID NO: 170 - DNA, 46 bp, Artificial Sequence
  Description of Artificial Sequence: Synthetic oligonucleotide
tcaactctgagtcccgtgaacaggatggctccgcgctcagcgcctt

SEQ ID NO: 171 - DNA, 46 bp, Artificial Sequence
  Description of Artificial Sequence: Synthetic oligonucleotide
tcaactctgagtcccgtgaacagaatggctccgcgctcagcgcctt

SEQ ID NO: 172 - DNA, 46 bp, Artificial Sequence
  Description of Artificial Sequence: Synthetic oligonucleotide
tcaactctgagtcccgtgaacagatggctccgcgctcagcgcctta

SEQ ID NO: 173 - DNA, 46 bp, Artificial Sequence
  Description of Artificial Sequence: Synthetic oligonucleotide
tcaactctgagtcccgtgaacagaatctccgcgctcagcgccttaa

SEQ ID NO: 174 - DNA, 46 bp, Artificial Sequence
  Description of Artificial Sequence: Synthetic oligonucleotide
tcaactctgagtcccgtgaacagaatctgcgcgctcagcgccttaa

SEQ ID NO: 175 - DNA, 46 bp, Artificial Sequence
  Description of Artificial Sequence: Synthetic oligonucleotide
tcaactctgagtcccgtgaacagaatccgcgctcagcgccttaacc

SEQ ID NO: 176 - DNA, 5914 bp, Artificial Sequence
  Description of Artificial Sequence: Synthetic polynucleotide
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcagaattaaccctcactaaagggactagtcctgcaggtttaaacgaattcgcccttgatacttattaaccataccttggaggggaaatcacacatgaaaagtgtcatttctttactaatcatattcatgtcttttctccccatagcaagacaaagacctgttttaaacacatttacaacctatatgttgccttgtactaggtaaaaagttgtacatttctgaaataattttggtatttctgttcagatcactaaactcaagaatcagcaattctctgaggctttcttttaaatatacataaggaactttcggagtgaagggagagtttgtcaataacttgatgcatgtgaaggggagataaaaaggttgctatttttcatcaacatattttgatttggctttctataattgatgggcttaaaagatctaatctactttaaacagatgccaaataaatggatgaatcttagaccctctataacagtaacttccttttaaaaaagacctctcccaccccacccccagcccaggctgtgtatgaaaactaagccatgtgcacaactctgactgggtcaccagcccacttgagtccgtgtcacaagcccacagatatttcctgctccccagtggatcgggtgtaaactgagcttgctcgctcgggagcctcttgctggaaaatagaacagcatttgcagaagcgtttggcaatgtgcttttggaagaagactaagaggtagtttctgaacttctccccgacaaaggcatagatgatggggttgatgcagcagtgcgtcatcccaagagtctctgtcacctgcatagcttggtccaacctgttagagctactgcaattattcaggccaaagaattcctggaaggtgttcaggagaaggacaatgttgtagggagcccagaagagaaaataaacaatcatgatggtgaagataagcctcacagccctgtgcctcttcttctcatttcgacaccgaagcagagtttttaggattcccgagtagcagatgaccatgacaagcagcggcaggaccagccccaagatgactatctttaatgtctggaaattcttccagaattgatactgactgtatggaaaatgagagctgcaggtgtaatgaagaccttctttttgagatctggtaaagatgattcctgggagagacgcaaacacagccaccacccaagtgatcacacttgtcaccaccccaaaggtgaccgtcctggcttttaaagcaaacacagcatggacgacagccaggtacctatcgattgtcaggaggatgatgaagaagattccagagaagaagcctataaaatagagccctgtcaagagttgacacattgtatttccaaagtcccactgggcggcagcatagtgagcccagaaggggacagtaagaaggaaaaacaggtcagagatggccaggttgagcaggtagatgtcagtcatgctcttcagccttttgcagttttctagacgaggcatccagtccagacgccatcagggcatactcactgatctagatgaggatgaccagcatgttgcccacaaaaccaaagatgaacaccagtgagtagagcggaggcaggaggcgggctgcgatttgcttcacattgattttttggcagggctccgatgtataataattgatgtcatagattggacttgacacttgataatccatcttgttccaccctgtgcataaataaaaagtgatcttttataaagtcctagaatgtatttagttgccctccatgaatgcaaactgttttatacatcaataggtttttaattgcctacatagatgtctacattgaattaactctctttttggccaagcaatgaagttttgtagtgaagggaaggtttgctgctagcttccctgtccactagatggagagcttggctctgttgggggaattcatgaaagcaccatctcaccaaataaaatcttgtgctctatagcaccatggagtgaatgaagctttgacaacaattaagggcgaattcgcggccgctaaattcaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 177 - DNA, 138 bp, Artificial Sequence; identical to SEQ ID NO: 134
  Description of Artificial Sequence: Synthetic polynucleotide

SEQ ID NO: 178 - DNA, 11 bp, Artificial Sequence
  Description of Artificial Sequence: Synthetic oligonucleotide
ttgacaatcct

SEQ ID NO: 179 - DNA, 11 bp, Artificial Sequence
  Description of Artificial Sequence: Synthetic oligonucleotide
ttgaccatcct

SEQ ID NO: 180 - DNA, 11 bp, Artificial Sequence
  Description of Artificial Sequence: Synthetic oligonucleotide
ttgacgatcct

SEQ ID NO: 181 - DNA, 11 bp, Artificial Sequence
  Description of Artificial Sequence: Synthetic oligonucleotide
ttgactatcct

SEQ ID NO: 182 - DNA, 11 bp, Artificial Sequence
  Description of Artificial Sequence: Synthetic oligonucleotide
ttgaccatcct

SEQ ID NO: 183 - DNA, 11 bp, Artificial Sequence
  Description of Artificial Sequence: Synthetic oligonucleotide
ttgactatcct

SEQ ID NO: 184 - DNA, 11 bp, Artificial Sequence
  Description of Artificial Sequence: Synthetic oligonucleotide
ttgacgatcct

SEQ ID NO: 185 - DNA, 16 bp, Artificial Sequence
  Description of Artificial Sequence: Synthetic oligonucleotide
gcagctgcccagacct

SEQ ID NO: 186 - DNA, 13 bp, Artificial Sequence
  Description of Artificial Sequence: Synthetic oligonucleotide
gaccctgcctgct

SEQ ID NO: 187 - DNA, 16 bp, Artificial Sequence
  Description of Artificial Sequence: Synthetic oligonucleotide
gaccctgcctgctcct

SEQ ID NO: 188 - DNA, 17 bp, Artificial Sequence
  Description of Artificial Sequence: Synthetic oligonucleotide
cacctgcagctgcccag

SEQ ID NO: 189 - DNA, 16 bp, Artificial Sequence
  Description of Artificial Sequence: Synthetic oligonucleotide
gggctctcccatgcat

SEQ ID NO: 190 - DNA, 16 bp, Artificial Sequence
  Description of Artificial Sequence: Synthetic oligonucleotide
tcctagaagggcaggc

SEQ ID NO: 191 - DNA, 14 bp, Artificial Sequence
  Description of Artificial Sequence: Synthetic oligonucleotide
ctgggctctcccat

SEQ ID NO: 192 - DNA, 17 bp, Artificial Sequence
  Description of Artificial Sequence: Synthetic oligonucleotide
cccccattcctagaagg

SEQ ID NO: 193 - DNA, 14 bp, Artificial Sequence
  Description of Artificial Sequence: Synthetic oligonucleotide
ccgcacccccagct

SEQ ID NO: 194 - DNA, 16 bp, Artificial Sequence
  Description of Artificial Sequence: Synthetic oligonucleotide
gctcctggcccttgca

SEQ ID NO: 195 - DNA, 17 bp, Artificial Sequence
  Description of Artificial Sequence: Synthetic oligonucleotide
ggcactccgcaccccca

SEQ ID NO: 196 - DNA, 17 bp, Artificial Sequence
  Description of Artificial Sequence: Synthetic oligonucleotide
accgctgtgctcctggc

SEQ ID NO: 197 - DNA, 15 bp, Artificial Sequence
  Description of Artificial Sequence: Synthetic oligonucleotide
ggcactccgcacccc

SEQ ID NO: 198 - DNA, 15 bp, Artificial Sequence
  Description of Artificial Sequence: Synthetic oligonucleotide
taccgctgtgctcct

SEQ ID NO: 199 - DNA, 16 bp, Artificial Sequence
  Description of Artificial Sequence: Synthetic oligonucleotide
acgccgtggaaaggcc

SEQ ID NO: 200 - DNA, 16 bp, Artificial Sequence
  Description of Artificial Sequence: Synthetic oligonucleotide
cggggatgatctacgg

SEQ ID NO: 201 - DNA, 15 bp, Artificial Sequence
  Description of Artificial Sequence: Synthetic oligonucleotide
acgccgtggaaaggc

SEQ ID NO: 202 - DNA, 14 bp, Artificial Sequence
  Description of Artificial Sequence: Synthetic oligonucleotide
cggggatgatctac

SEQ ID NO: 203 - DNA, 16 bp, Artificial Sequence
  Description of Artificial Sequence: Synthetic oligonucleotide
acgccgtggaaaggcc

SEQ ID NO: 204 - DNA, 14 bp, Artificial Sequence
  Description of Artificial Sequence: Synthetic oligonucleotide
cggggatgatctac

SEQ ID NO: 205 - DNA, 15 bp, Artificial Sequence
  Description of Artificial Sequence: Synthetic oligonucleotide
cgttgcccccgccct

SEQ ID NO: 206 - DNA, 15 bp, Artificial Sequence
  Description of Artificial Sequence: Synthetic oligonucleotide
atgagcggccccgcc

SEQ ID NO: 207 - DNA, 16 bp, Artificial Sequence
  Description of Artificial Sequence: Synthetic oligonucleotide
gagcggccccgcccgt

SEQ ID NO: 208 - DNA, 15 bp, Artificial Sequence
  Description of Artificial Sequence: Synthetic oligonucleotide
cgttgcccccgccct

SEQ ID NO: 209 - DNA, 15 bp, Artificial Sequence
  Description of Artificial Sequence: Synthetic oligonucleotide
atgagcggccccgcc

SEQ ID NO: 210 - DNA, 16 bp, Artificial Sequence
  Description of Artificial Sequence: Synthetic oligonucleotide
gaatcgttgcccccgc

SEQ ID NO: 211 - DNA, 16 bp, Artificial Sequence
  Description of Artificial Sequence: Synthetic oligonucleotide
gagcggccccgcccgt

SEQ ID NO: 212 - DNA, 16 bp, Artificial Sequence
  Description of Artificial Sequence: Synthetic oligonucleotide
gaatcgttgcccccgc

SEQ ID NO: 213 - DNA, 51 bp, Artificial Sequence
  Description of Artificial Sequence: Synthetic oligonucleotide
tcccctccaccccacagtggggccactagggacaggattggtgacagaaaa

SEQ ID NO: 214 - DNA, 51 bp, Artificial Sequence
  Description of Artificial Sequence: Synthetic oligonucleotide
ttttctgtcaccaatcctgtccctagtggccccactgtggggtggagggga

SEQ ID NO: 215 - DNA, 51 bp, Artificial Sequence
  Description of Artificial Sequence: Synthetic oligonucleotide
tccagcctgatggaacttataagggagaaagtgatttgcagttggaaagaa

SEQ ID NO: 216 - DNA, 51 bp, Artificial Sequence
  Description of Artificial Sequence: Synthetic oligonucleotide
ttctttccaactgcaaatcactttctcccttataagttccatcaggctgga

SEQ ID NO: 217 - DNA, 5991 bp, Artificial Sequence
  Description of Artificial Sequence: Synthetic polynucleotide
gactcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagctgatccactagtccagtgtggtggaattcgccatggactacaaagaccatgacggtgattataaagatcatgacatcgattacaaggatgacgatgacaagatggcccccaagaagaagaggaaggtgggcattcacggggtacccgccgctgtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaaccttactcccgaacaagtagtagcgatagccagtaataacggaggtaaacaagccttggagacggtccaaaggttgctcccggtcttgtgtcaggcacatgggctgacgcctcaacaggtcgtcgcgatagcgtctaataatggaggaaagcaagctctggaaaccgtccagcgactccttccggttctgtgccaggctcatggtctgactccgcagcaagtcgttgctatagcgtccaacatcggaggcaaacaggccctggagaccgtgcagcggttgttgcctgtgctttgccaagcccacgggcttacgcctgagcaagtggtggcgattgccagtaacaacggcggcaaacaagcccttgagactgtgcagaggctcttgccggtactctgccaagcacacggcttgacccccgagcaggttgtagccatagctagtcacgacgggggtaagcaagcgttggaaacggtgcaagcacttctccccgttctctgtcaagcgcatggacttaccccggaacaggtggtcgccattgcaagccatgatggaggaaagcaggcgctcgaaacagtccaggcacttttgcccgtactttgtcaagctcacggtctcaccccggaacaggtggtagccattgcatctaacatcggaggtaagcaagcattggaaacggttcaggccctgttgcctgtactttgccaggcgcacggtctgacacctgagcaggttgtcgccatcgctagcaacggaggtgggaaacaggcacttgaaactgtgcagaggcttctgccggtgctgtgccaagcgcatggccttacacccgagcaagtagtggctattgcgagtcatgatggaggcaagcaagcgctggagactgtccaacgacttcttccggtcttgtgtcaggcacatggattgacccctcaacaagtcgtggcgatagctagcaacggcggtggaaaacaggccctcgaaaccgtccagcgactgctccccgtactgtgtcaagcccatggacttaccccagaacaagttgtggcgattgcctctaacaatggtgggaagcaagctcttgagacggtgcaggcgttgttgcccgtgctttgtcaagctcacgggctcacgccagagcaagtggtcgctatcgcgagtaataaagggggcaaacaagccttggagacagtgcaaaggctcctgccagtgctctgccaggctcatggtttgacacccgaacaggtagttgcaatagcgagtcatgatggcggaaagcaagctcttgaaactgtgcagcggctgttgcctgtactgtgtcaagcccacgggctgacaccggaacaagttgtagcgatcgctagccacgatggcgggaaacaagctctggaaacggtacagagactcctcccagtgctttgtcaggcacacggcctcacgccagagcaggttgtcgccatcgcgtcaaacaatggtggaaagcaggccctggagacagtccaacggttgctgccggtcctttgccaggctcacgggttgaccccccagcaggtcgtggccattgcctcaaacaagggcggtaggccagcattggagacggtgcagaggcttctgcctgtgctctgccaagcgcatggactcacccccgagcaagtggttgctatcgcaagtaacaacggagggaaacaagcgctcgaaaccgtgcaaaggttgctccccgttctctgtcaggcgcacggtcttacgccacaacaggtggtggcgattgcatctaatggaggcggacgccctgccttggagagcattgtggcccagctgtccaggccggaccctgccctggccgcgttaaccaacgaccacctcgtcgccttggcctgcctcggcggaggttctggcggcagcggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatcttgataactcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctt

SEQ ID NO: 218 - protein, 1008 aa, Artificial Sequence
  Description of Artificial Sequence: Synthetic polypeptide
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNNGGKQALETVQRLLPVLCQAHGLTPQQVVAIASNNGGKQALETVQRLLPVLCQAHGLTPQQVVAIASNIGGKQALETVQRLLPVLCQAHGLTPEQVVAIASNNGGKQALETVQRLLPVLCQAHGLTPEQVVAIASHDGGKQALETVQALLPVLCQAHGLTPEQVVAIASHDGGKQALETVQALLPVLCQAHGLTPEQVVAIASNIGGKQALETVQALLPVLCQAHGLTPEQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNNGGKQALETVQALLPVLCQAHGLTPEQVVAIASNKGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNNGGKQALETVQRLLPVLCQAHGLTPQQVVAIASNKGGRPALETVQRLLPVLCQAHGLTPEQVVAIASNNGGKQALETVQRLLPVLCQAHGLTPQQVVAIASNGGGRPALESIVAQLSRPDPALAALTNDHLVALACLGGGSGGSGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 219 - DNA, 3024 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcacggggtacccgccgctgtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaaccttactcccgaacaagtagtagcgatagccagtaataacggaggtaaacaagccttggagacggtccaaaggttgctcccggtcttgtgtcaggcacatgggctgacgcctcaacaggtcgtcgcgatagcgtctaataatggaggaaagcaagctctggaaaccgtccagcgactccttccggttctgtgccaggctcatggtctgactccgcagcaagtcgttgctatagcgtccaacatcggaggcaaacaggccctggagaccgtgcagcggttgttgcctgtgctttgccaagcccacgggcttacgcctgagcaagtggtggcgattgccagtaacaacggcggcaaacaagcccttgagactgtgcagaggctcttgccggtactctgccaagcacacggcttgacccccgagcaggttgtagccatagctagtcacgacgggggtaagcaagcgttggaaacggtgcaagcacttctccccgttctctgtcaagcgcatggacttaccccggaacaggtggtcgccattgcaagccatgatggaggaaagcaggcgctcgaaacagtccaggcacttttgcccgtactttgtcaagctcacggtctcaccccggaacaggtggtagccattgcatctaacatcggaggtaagcaagcattggaaacggttcaggccctgttgcctgtactttgccaggcgcacggtctgacacctgagcaggttgtcgccatcgctagcaacggaggtgggaaacaggcacttgaaactgtgcagaggcttctgccggtgctgtgccaagcgcatggccttacacccgagcaagtagtggctattgcgagtcatgatggaggcaagcaagcgctggagactgtccaacgacttcttccggtcttgtgtcaggcacatggattgacccctcaacaagtcgtggcgatagctagcaacggcggtggaaaacaggccctcgaaaccgtccagcgactgctccccgtactgtgtcaagcccatggacttaccccagaacaagttgtggcgattgcctctaacaatggtgggaagcaagctcttgagacggtgcaggcgttgttgcccgtgctttgtcaagctcacgggctcacgccagagcaagtggtcgctatcgcgagtaataaagggggcaaacaagccttggagacagtgcaaaggctcctgccagtgctctgccaggctcatggtttgacacccgaacaggtagttgcaatagcgagtcatgatggcggaaagcaagctcttgaaactgtgcagcggctgttgcctgtactgtgtcaagcccacgggctgacaccggaacaagttgtagcgatcgctagccacgatggcgggaaacaagctctggaaacggtacagagactcctcccagtgctttgtcaggcacacggcctcacgccagagcaggttgtcgccatcgcgtcaaacaatggtggaaagcaggccctggagacagtccaacggttgctgccggtcctttgccaggctcacgggttgaccccccagcaggtcgtggccattgcctcaaacaagggcggtaggccagcattggagacggtgcagaggcttctgcctgtgctctgccaagcgcatggactcacccccgagcaagtggttgctatcgcaagtaacaacggagggaaacaagcgctcgaaaccgtgcaaaggttgctccccgttctctgtcaggcgcacggtcttacgccacaacaggtggtggcgattgcatctaatggaggcggacgccctgccttggagagcattgtggcccagctgtccaggccggaccctgccctggccgcgttaaccaacgaccacctcgtcgccttggcctgcctcggcggaggttctggcggcagcggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 220 - protein, 1036 aa, Artificial Sequence
  Description of Artificial Sequence: Synthetic polypeptide
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNNGGKQALETVQRLLPVLCQAHGLTPQQVVAIASNNGGKQALETVQRLLPVLCQAHGLTPQQVVAIASNIGGKQALETVQRLLPVLCQAHGLTPEQVVAIASNNGGKQALETVQRLLPVLCQAHGLTPEQVVAIASHDGGKQALETVQALLPVLCQAHGLTPEQVVAIASHDGGKQALETVQALLPVLCQAHGLTPEQVVAIASNIGGKQALETVQALLPVLCQAHGLTPEQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNNGGKQALETVQALLPVLCQAHGLTPEQVVAIASNKGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNNGGKQALETVQRLLPVLCQAHGLTPQQVVAIASNKGGRPALETVQRLLPVLCQAHGLTPEQVVAIASNNGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 221 - DNA, 3108 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcacggggtacccatggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaaccttactcccgaacaagtagtagcgatagccagtaataacggaggtaaacaagccttggagacggtccaaaggttgctcccggtcttgtgtcaggcacatgggctgacgcctcaacaggtcgtcgcgatagcgtctaataatggaggaaagcaagctctggaaaccgtccagcgactccttccggttctgtgccaggctcatggtctgactccgcagcaagtcgttgctatagcgtccaacatcggaggcaaacaggccctggagaccgtgcagcggttgttgcctgtgctttgccaagcccacgggcttacgcctgagcaagtggtggcgattgccagtaacaacggcggcaaacaagcccttgagactgtgcagaggctcttgccggtactctgccaagcacacggcttgacccccgagcaggttgtagccatagctagtcacgacgggggtaagcaagcgttggaaacggtgcaagcacttctccccgttctctgtcaagcgcatggacttaccccggaacaggtggtcgccattgcaagccatgatggaggaaagcaggcgctcgaaacagtccaggcacttttgcccgtactttgtcaagctcacggtctcaccccggaacaggtggtagccattgcatctaacatcggaggtaagcaagcattggaaacggttcaggccctgttgcctgtactttgccaggcgcacggtctgacacctgagcaggttgtcgccatcgctagcaacggaggtgggaaacaggcacttgaaactgtgcagaggcttctgccggtgctgtgccaagcgcatggccttacacccgagcaagtagtggctattgcgagtcatgatggaggcaagcaagcgctggagactgtccaacgacttcttccggtcttgtgtcaggcacatggattgacccctcaacaagtcgtggcgatagctagcaacggcggtggaaaacaggccctcgaaaccgtccagcgactgctccccgtactgtgtcaagcccatggacttaccccagaacaagttgtggcgattgcctctaacaatggtgggaagcaagctcttgagacggtgcaggcgttgttgcccgtgctttgtcaagctcacgggctcacgccagagcaagtggtcgctatcgcgagtaataaagggggcaaacaagccttggagacagtgcaaaggctcctgccagtgctctgccaggctcatggtttgacacccgaacaggtagttgcaatagcgagtcatgatggcggaaagcaagctcttgaaactgtgcagcggctgttgcctgtactgtgtcaagcccacgggctgacaccggaacaagttgtagcgatcgctagccacgatggcgggaaacaagctctggaaacggtacagagactcctcccagtgctttgtcaggcacacggcctcacgccagagcaggttgtcgccatcgcgtcaaacaatggtggaaagcaggccctggagacagtccaacggttgctgccggtcctttgccaggctcacgggttgaccccccagcaggtcgtggccattgcctcaaacaagggcggtaggccagcattggagacggtgcagaggcttctgcctgtgctctgccaagcgcatggactcacccccgagcaagtggttgctatcgcaagtaacaacggagggaaacaagcgctcgaaaccgtgcaaaggttgctccccgttctctgtcaggcgcacggtcttacgccacaacaggtggtggcgattgcatctaatggaggcggacgccctgccttggagagcattgtggcccagctgtccaggccggaccctgccctggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 222 - protein, 1001 aa, Artificial Sequence
  Description of Artificial Sequence: Synthetic polypeptide
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNNGGKQALETVQRLLPVLCQAHGLTPAQVVAIASNIGGKQALETVQRLLPVLCQAHGLTPDQVVAIASNIGGKQALETVQRLLPVLCQAHGLTPAQVVAIASHDGGKQALETVQRLLPVLCQAHGLTPEQVVAIASNIGGKQALETVQRLLPVLCQAHGLTPDQVVAIASNKGGKQALETVQRLLPVLCQAHGLTPDQVVAIASNIGGKQALETVQRLLPVLCQAHGLTPEQVVAIASNIGGKQALETVQRLLPVLCQAHGLTPDQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNKGGKQALETVQRLLPVLCQAHGLTPDQVVAIASHDGGKQALETVQRLLPVLCQAHGLTPAQVVAIASNNGGKQALETVQRLLPVLCQAHGLTPEQVVAIASHDGGKQALETVQRLLPVLCQAHGLTPQQVVAIASNKGGKQALETVQRLLPVLCQAHGLTPEQVVAIASNNGGKQALETVQRLLPVLCQAHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 223 - DNA, 3003 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcacggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaatcttactccagagcaggtcgtcgcaatcgcgtcgaataacgggggaaagcaagcactggaaaccgtgcagaggttgttgccggtcttgtgtcaggctcacggcttgacacctgcccaagtggtggccattgcgtcgaacatcgggggaaaacaggcacttgaaacagtccagagacttttgcccgtcctctgccaggcgcacggcctcacgccggatcaggtggtagccatcgcgtcaaacatcggagggaagcaggctctggaaacggtgcagcggcttttgccggtactttgccaagctcatgggctcacgccagcccaagtggtagctatcgcatcgcacgacggagggaagcaggccttggagacagtgcaacggctcctccccgtgttgtgccaggcacatgggttgactccagagcaggtcgtagcaatcgcctccaatatcgggggaaagcaagcgttggagacagtgcagcgactgctgcctgtgctttgccaggctcatggcctgacgcccgatcaggtagtggcaatcgcgtcaaacaaaggtggaaagcaggcactcgaaacggtacagcgcttgctgcccgtcttgtgtcaggcccacggtctgacacccgaccaggtagtcgcgattgcgtcgaacatcgggggaaagcaagcgttggaaacggtacaacgcctgctcccggtgctctgccaggctcatggacttacacccgagcaggtggtcgccatcgcgtcaaacatcggaggcaaacaggcattggagacagtgcagcgccttctcccagtcttgtgtcaggcccacggtctgacacccgaccaggtcgtcgcgattgcatcgaatggaggtgggaaacaggcccttgagacagtacagaggcttttgcccgtgttgtgccaggcccacggactcacacccgaacaagtcgtcgccattgccagccatgatggaggtaaacaggcacttgagactgtccagcgcctcctgccggtgctgtgccaagcacatgggctgaccccgcagcaagtcgtagcgatcgcctcgaatggtggaggaaaacaagcgcttgaaaccgtccagaggttgctcccggtgctgtgccaggcacatggccttacgcctgaacaagtagtcgcgattgccagcaacaaaggcggaaaacaggctctcgaaacggtccagcggttgctgccggtgttgtgccaggcgcacggtcttacaccggaccaggtggtggcgattgcctcccacgatgggggtaaacaggcactggaaaccgtgcagagattgctcccagtactttgtcaggcacatggtctgactcctgctcaagtggtcgcgatcgcctcgaacaatggcggaaagcaggcgctcgaaacggtacagcggctccttccggtgctctgccaagcccacggattgacgccagaacaggtcgtggcaattgcgtcacacgacggtggaaagcaggcgctcgaaactgtgcaaagactcctgcccgtactctgccaggcacacggtttgactccccagcaggtagtggccatcgcgagcaataagggaggaaagcaggcgcttgaaacggtgcagagacttctgcccgtgctttgtcaagcccacgggctgactccggagcaggtagtggccatcgcctcaaacaacggaggaaagcaagctctcgaaaccgtacagaggcttctccccgtgctctgtcaggcccacgggttgacccccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 224 - protein, 1036 aa, Artificial Sequence
  Description of Artificial Sequence: Synthetic polypeptide
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNNGGKQALETVQRLLPVLCQAHGLTPAQVVAIASNIGGKQALETVQRLLPVLCQAHGLTPDQVVAIASNIGGKQALETVQRLLPVLCQAHGLTPAQVVAIASHDGGKQALETVQRLLPVLCQAHGLTPEQVVAIASNIGGKQALETVQRLLPVLCQAHGLTPDQVVAIASNKGGKQALETVQRLLPVLCQAHGLTPDQVVAIASNIGGKQALETVQRLLPVLCQAHGLTPEQVVAIASNIGGKQALETVQRLLPVLCQAHGLTPDQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNKGGKQALETVQRLLPVLCQAHGLTPDQVVAIASHDGGKQALETVQRLLPVLCQAHGLTPAQVVAIASNNGGKQALETVQRLLPVLCQAHGLTPEQVVAIASHDGGKQALETVQRLLPVLCQAHGLTPQQVVAIASNKGGKQALETVQRLLPVLCQAHGLTPEQVVAIASNNGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 225 - DNA, 3108 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcacggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaatcttactccagagcaggtcgtcgcaatcgcgtcgaataacgggggaaagcaagcactggaaaccgtgcagaggttgttgccggtcttgtgtcaggctcacggcttgacacctgcccaagtggtggccattgcgtcgaacatcgggggaaaacaggcacttgaaacagtccagagacttttgcccgtcctctgccaggcgcacggcctcacgccggatcaggtggtagccatcgcgtcaaacatcggagggaagcaggctctggaaacggtgcagcggcttttgccggtactttgccaagctcatgggctcacgccagcccaagtggtagctatcgcatcgcacgacggagggaagcaggccttggagacagtgcaacggctcctccccgtgttgtgccaggcacatgggttgactccagagcaggtcgtagcaatcgcctccaatatcgggggaaagcaagcgttggagacagtgcagcgactgctgcctgtgctttgccaggctcatggcctgacgcccgatcaggtagtggcaatcgcgtcaaacaaaggtggaaagcaggcactcgaaacggtacagcgcttgctgcccgtcttgtgtcaggcccacggtctgacacccgaccaggtagtcgcgattgcgtcgaacatcgggggaaagcaagcgttggaaacggtacaacgcctgctcccggtgctctgccaggctcatggacttacacccgagcaggtggtcgccatcgcgtcaaacatcggaggcaaacaggcattggagacagtgcagcgccttctcccagtcttgtgtcaggcccacggtctgacacccgaccaggtcgtcgcgattgcatcgaatggaggtgggaaacaggcccttgagacagtacagaggcttttgcccgtgttgtgccaggcccacggactcacacccgaacaagtcgtcgccattgccagccatgatggaggtaaacaggcacttgagactgtccagcgcctcctgccggtgctgtgccaagcacatgggctgaccccgcagcaagtcgtagcgatcgcctcgaatggtggaggaaaacaagcgcttgaaaccgtccagaggttgctcccggtgctgtgccaggcacatggccttacgcctgaacaagtagtcgcgattgccagcaacaaaggcggaaaacaggctctcgaaacggtccagcggttgctgccggtgttgtgccaggcgcacggtcttacaccggaccaggtggtggcgattgcctcccacgatgggggtaaacaggcactggaaaccgtgcagagattgctcccagtactttgtcaggcacatggtctgactcctgctcaagtggtcgcgatcgcctcgaacaatggcggaaagcaggcgctcgaaacggtacagcggctccttccggtgctctgccaagcccacggattgacgccagaacaggtcgtggcaattgcgtcacacgacggtggaaagcaggcgctcgaaactgtgcaaagactcctgcccgtactctgccaggcacacggtttgactccccagcaggtagtggccatcgcgagcaataagggaggaaagcaggcgcttgaaacggtgcagagacttctgcccgtgctttgtcaagcccacgggctgactccggagcaggtagtggccatcgcctcaaacaacggaggaaagcaagctctcgaaaccgtacagaggcttctccccgtgctctgtcaggcccacgggttgacccccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 226 - protein, 829 aa, Artificial Sequence
  Description of Artificial Sequence: Synthetic polypeptide
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPSLAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 227 - DNA, 2487 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcacggggtacccatggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccgtcgttggccgcgttaaccaacgaccacctcgtcgccttggcctgcctcggcggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 228 - protein, 840 aa, Artificial Sequence
  Description of Artificial Sequence: Synthetic polypeptide
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPSLAALTNDHLVALACLGGRPALDAVKKGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 229 - DNA, 2520 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcacggggtacccatggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccgtcgttggccgcgttaaccaacgaccacctcgtcgccttggcctgcctcggcggacgtcctgcgctggatgcagtgaaaaagggaggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 230 - protein, 851 aa, Artificial Sequence
  Description of Artificial Sequence: Synthetic polypeptide
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPSLAALTNDHLVALACLGGRPALDAVKKGLPHAPALIKRTGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 231 - DNA, 2553 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcacggggtacccatggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccgtcgttggccgcgttaaccaacgaccacctcgtcgccttggcctgcctcggcggacgtcctgcgctggatgcagtgaaaaagggattgccgcacgcgccggccttgatcaaaagaaccggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 232 - protein, 864 aa, Artificial Sequence
  Description of Artificial Sequence: Synthetic polypeptide
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPSLAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 233 - DNA, 2592 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcacggggtacccatggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccgtcgttggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 234 - protein, 880 aa, Artificial Sequence
  Description of Artificial Sequence: Synthetic polypeptide
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPSLAALTNDHLVALACLGGRPALDAVKKGLPHAPALIKRTNRRIPERTSHRVADHAQVVRVLGFFQCHSGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 235 - DNA, 2640 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcacggggtacccatggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccgtcgttggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactccggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 236 - protein, 896 aa, Artificial Sequence
  Description of Artificial Sequence: Synthetic polypeptide
MDYKDHDGDYKDHDIDYKDDDDKMAPKKKRKVGIHGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPSLAALTNDHLVALACLGGRPALDAVKKGLPHAPALIKRTNRRIPERTSHRVADHAQVVRVLGFFQCHSHPAQAFDDAMTQFGMSGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 237 - DNA, 2688 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcacggggtacccatggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccgtcgttggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 238 - DNA, 5667 bp, Artificial Sequence
  Description of Artificial Sequence: Synthetic polynucleotide
gactcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagagccaagctgactagcgtttaaacttaagctgatccactagtccagtgtggtggaattcgccatggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggactcaccccagaccaggtagtcgcaatcgccaacaataacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacgcctgcacaagtggtcgccatcgcctccaatattggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatcttgataactcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctt

SEQ ID NO: 239 - protein, 900 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIANNNGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASNGGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASHDGGKQALETVQRLLPVLCQDHGLTPAQVVAIASNIGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 240 - DNA, 2700 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggactcaccccagaccaggtagtcgcaatcgccaacaataacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacgcctgcacaagtggtcgccatcgcctccaatattggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 241 - protein, 935 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIANNNGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASNGGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASHDGGKQALETVQRLLPVLCQDHGLTPAQVVAIASNIGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 242 - DNA, 2805 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggactcaccccagaccaggtagtcgcaatcgccaacaataacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacgcctgcacaagtggtcgccatcgcctccaatattggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 243 - protein, 900 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPDQVVAIANNNGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASHDGGKQALETVQRLLPVLCQDHGLTPDQVVAIASNGGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIASNGGGKQALETVQRLLPVLCQDHGLTPDQVVAIASHDGGKQALETVQRLLPVLCQDHGLTPAQVVAIASHDGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 244 - DNA, 2700 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggaccatggactcaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 245 - protein, 935 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPDQVVAIANNNGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASHDGGKQALETVQRLLPVLCQDHGLTPDQVVAIASNGGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIASNGGGKQALETVQRLLPVLCQDHGLTPDQVVAIASHDGGKQALETVQRLLPVLCQDHGLTPAQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 246 - DNA, 2805 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 247 - protein, 900 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASNIGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASNGGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIANNNGGKQALETVQRLLPVLCQDHGLTPAQVVAIASNIGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 248 - DNA, 2700 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagccatgatggagggaaacaggcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgccaacaataacgggggaaagcaagccctggaaaccgtgcaaaggttgttgccggtcctttgtcaagaccacggccttacgcctgcacaagtggtcgccatcgcctccaatattggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 249 - protein, 935 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASNIGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASNGGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIANNNGGKQALETVQRLLPVLCQDHGLTPAQVVAIASNIGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 250 - DNA, 2805 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagccatgatggagggaaacaggcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgccaacaataacgggggaaagcaagccctggaaaccgtgcaaaggttgttgccggtcctttgtcaagaccacggccttacgcctgcacaagtggtcgccatcgcctccaatattggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 251 - protein, 968 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASHDGGKQALETVQRLLPVLCQDHGLTPDQVVAIASNGGGKQALETVQRLLPVLCQDHGLTPDQVVAIANNNGGKQALETVQRLLPVLCQAHGLTPDQVVAIASNIGGKQALETVQRLLPVLCQAHGLTPAQVVAIASNGGGKQALETVQRLLPVLCQDHGLTPDQVVAIASNIGGKQALETVQRLLPVLCQDHGLTPEQVVAIASNIGGKQALETVQRLLPVLCQAHGLTPDQVVAIASNIGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 252 - DNA, 2904 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatctaatatcggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 253 - protein, 1003 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASHDGGKQALETVQRLLPVLCQDHGLTPDQVVAIASNGGGKQALETVQRLLPVLCQDHGLTPDQVVAIANNNGGKQALETVQRLLPVLCQAHGLTPDQVVAIASNIGGKQALETVQRLLPVLCQAHGLTPAQVVAIASNGGGKQALETVQRLLPVLCQDHGLTPDQVVAIASNIGGKQALETVQRLLPVLCQDHGLTPEQVVAIASNIGGKQALETVQRLLPVLCQAHGLTPDQVVAIASNIGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 254 - DNA, 3009 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatctaatatcggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 255 - protein, 900 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNGGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIANNNGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASNGGGKQALETVQRLLPVLCQDHGLTPAQVVAIASNGGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 256 - DNA, 2700 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgaatggcgggggaaagcaagccctggaaaccgtgcaaaggttgttgccggtcctttgtcaagaccacggccttacgcctgcacaagtggtcgccatcgcctccaacggtggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 257 - protein, 935 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNGGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIANNNGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASNGGGKQALETVQRLLPVLCQDHGLTPAQVVAIASNGGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 258 - DNA, 2805 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgaatggcgggggaaagcaagccctggaaaccgtgcaaaggttgttgccggtcctttgtcaagaccacggccttacgcctgcacaagtggtcgccatcgcctccaacggtggcggtaagcaggcgctggaaacagtacagcgcctgctgcctgtactgtgccaggatcatggcttgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 259 - protein, 832 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNGGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIANNNGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNGGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 260 - DNA, 2496 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 261 - protein, 867 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNGGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIANNNGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNGGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 262 - DNA, 2601 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 263 - protein, 900 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASNIGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASNGGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIANNNGGKQALETVQRLLPVLCQDHGLTPDQVVAIASHDGGKQALETVQRLLPVLCQDHGLTPAQVVAIASHDGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 264 - DNA, 2700 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 265 - protein, 935 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASNIGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASNGGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIANNNGGKQALETVQRLLPVLCQDHGLTPDQVVAIASHDGGKQALETVQRLLPVLCQDHGLTPAQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 266 - DNA, 2805 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 267 - protein, 866 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIANNNGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASNGGGKQALETVQRLLPVLCQDHGLTPDQVVAIANNNGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASHDGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 268 - DNA, 2598 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatggactcaccccagaccaggtagtcgcaatcgccaacaataacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 269 - protein, 901 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIANNNGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASNGGGKQALETVQRLLPVLCQDHGLTPDQVVAIANNNGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 270 - DNA, 2703 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatggactcaccccagaccaggtagtcgcaatcgccaacaataacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgaatggcgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 271 - protein, 832 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIASNIGGKQALETVQRLLPVLCQDHGLTPDQVVAIASHDGGKQALETVQRLLPVLCQDHGLTPEQVVAIASNIGGKQALETVQRLLPVLCQAHGLTPDQVVAIASHDGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 272 - DNA, 2496 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 273 - protein, 867 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIASNIGGKQALETVQRLLPVLCQDHGLTPDQVVAIASHDGGKQALETVQRLLPVLCQDHGLTPEQVVAIASNIGGKQALETVQRLLPVLCQAHGLTPDQVVAIASHDGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 274 - DNA, 2601 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 275 - protein, 968 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIASNGGGKQALETVQRLLPVLCQDHGLTPDQVVAIASNGGGKQALETVQRLLPVLCQDHGLTPEQVVAIASNIGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASHDGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASHDGGKQALETVQRLLPVLCQDHGLTPEQVVAIASNIGGKQALETVQRLLPVLCQAHGLTPDQVVAIANNNGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 276 - DNA, 2904 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggactcaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggaccatgggctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 277 - protein, 1003 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIASNGGGKQALETVQRLLPVLCQDHGLTPDQVVAIASNGGGKQALETVQRLLPVLCQDHGLTPEQVVAIASNIGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASHDGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASHDGGKQALETVQRLLPVLCQDHGLTPEQVVAIASNIGGKQALETVQRLLPVLCQAHGLTPDQVVAIANNNGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 278 - DNA, 3009 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggactcaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 279 - protein, 866 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNIGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIASHDGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIANNNGGKQALETVQRLLPVLCQAHGLTPAQVVAIASHDGGKQALETVQRLLPVLCQDHGLTPDQVVAIASNIGGKQALETVQRLLPVLCQDHGLTPDQVVAIANNNGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASHDGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 280 - DNA, 2598 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatgggctgaccccagaccaggtagtcgcaatcgcgtcgaacattgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 281 - protein, 901 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNIGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIASHDGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIANNNGGKQALETVQRLLPVLCQAHGLTPAQVVAIASHDGGKQALETVQRLLPVLCQDHGLTPDQVVAIASNIGGKQALETVQRLLPVLCQDHGLTPDQVVAIANNNGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 282 - DNA, 2703 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatgggctgaccccagaccaggtagtcgcaatcgcgtcgaacattgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 283 - protein, 968 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNIGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIASHDGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIANNNGGKQALETVQRLLPVLCQAHGLTPAQVVAIASHDGGKQALETVQRLLPVLCQDHGLTPDQVVAIASNIGGKQALETVQRLLPVLCQDHGLTPDQVVAIANNNGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 284 - DNA, 2904 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatgggctgaccccagaccaggtagtcgcaatcgcgtcgaacattgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 285 - protein, 1003 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNIGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIASHDGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIANNNGGKQALETVQRLLPVLCQAHGLTPAQVVAIASHDGGKQALETVQRLLPVLCQDHGLTPDQVVAIASNIGGKQALETVQRLLPVLCQDHGLTPDQVVAIANNNGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASNIGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 286 - DNA, 3009 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatgggctgaccccagaccaggtagtcgcaatcgcgtcgaacattgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagccatgatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 287 - protein, 866 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPEQVVAIASNIGGKQALETVQRLLPVLCQAHGLTPDQVVAIASNGGGKQALETVQRLLPVLCQAHGLTPAQVVAIASNIGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIANNNGGKQALETVQRLLPVLCQAHGLTPAQVVAIASNIGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIANNNGGKQALETVQRLLPVLCQAHGLTPAQVVAIASNGGGKQALETVQRLLPVLCQDHGLTPDQVVAIASNIGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 288 - DNA, 2598 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgaacattgggggaaagcaagccctggaaaccgtgcaaaggttgttgccggtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 289 - protein, 901 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIANNNGGKQALETVQRLLPVLCQDHGLTPEQVVAIASNIGGKQALETVQRLLPVLCQAHGLTPDQVVAIASNGGGKQALETVQRLLPVLCQAHGLTPAQVVAIASNIGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIANNNGGKQALETVQRLLPVLCQAHGLTPAQVVAIASNIGGKQALETVQRLLPVLCQDHGLTPDQVVAIASHDGGKQALETVQRLLPVLCQDHGLTPEQVVAIASNGGGKQALETVQRLLPVLCQAHGLTPDQVVAIANNNGGKQALETVQRLLPVLCQAHGLTPAQVVAIASNGGGKQALETVQRLLPVLCQDHGLTPDQVVAIASNIGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 290 - DNA, 2703 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgcgtcgaacattgggggaaagcaagccctggaaaccgtgcaaaggttgttgccggtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 291 - protein, 832 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGLTPDQVVAIANNNGGKQALETVQRLLPVLCQAHGLTPDQVVAIASNIGGKQALETVQRLLPVLCQAHGLTPAQVVAIASNGGGKQALETVQRLLPVLCQDHGLTPDQVVAIASNIGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASNIGGKQALETVQRLLPVLCQDHGLTPEQVVAIASHDGGKQALETVQRLLPVLCQAHGLTPDQVVAIASNGGGKQTLETVQRLLPVLCQAHGLTPAQVVAIANNNGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 292 - DNA, 2496 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgaatggcgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggactcaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatgggctgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaaacattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 293 - protein, 867 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGLTPDQVVAIANNNGGKQALETVQRLLPVLCQAHGLTPDQVVAIASNIGGKQALETVQRLLPVLCQAHGLTPAQVVAIASNGGGKQALETVQRLLPVLCQDHGLTPDQVVAIASNIGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASNIGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIANNNGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 294 - DNA, 2601 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgaatggcgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggactcaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatgggctgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 295 - protein, 968 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASHDGGKQALETVQRLLPVLCQDHGLTPEQVVAIASNIGGKQALETVQRLLPVLCQAHGLTPDQVVAIANNNGGKQALETVQRLLPVLCQAHGLTPAQVVAIASNIGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASNIGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 296 - DNA, 2904 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggtttgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 297 - protein, 1003 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASHDGGKQALETVQRLLPVLCQDHGLTPEQVVAIASNIGGKQALETVQRLLPVLCQAHGLTPDQVVAIANNNGGKQALETVQRLLPVLCQAHGLTPAQVVAIASNIGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASNIGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 298 - DNA, 3009 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatgggctgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggtttgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaacggaggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 299 - protein, 900 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIASNGGGKQALETVQRLLPVLCQDHGLTPDQVVAIASHDGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIANNNGGKQALETVQRLLPVLCQDHGLTPDQVVAIASNIGGKQALETVQRLLPVLCQDHGLTPEQVVAIASNIGGKQALETVQRLLPVLCQAHGLTPDQVVAIASNGGGKQALETVQRLLPVLCQAHGLTPAQVVAIASNGGGKQALETVQRLLPVLCQDHGLTPDQVVAIANNNGGKQALETVQRLLPVLCQDHGLTPAQVVAIASNIGGKQALETVQRLLPVLCQDHGLTPEQVVAIASNGGGRPALESIVAQLSRPDPALAALTNDHLVALACLGGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 300 - DNA, 2700 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatgggctgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgccaacaataacgggggaaagcaagccctggaaaccgtgcaaaggttgttgccggtcctttgtcaagaccacggccttacgcctgcacaagtggtcgccatcgcctccaatattggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 301 - protein, 935 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIASNGGGKQALETVQRLLPVLCQDHGLTPDQVVAIASHDGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIANNNGGKQALETVQRLLPVLCQDHGLTPDQVVAIASNIGGKQALETVQRLLPVLCQDHGLTPEQVVAIASNIGGKQALETVQRLLPVLCQAHGLTPDQVVAIASNGGGKQALETVQRLLPVLCQAHGLTPAQVVAIASNGGGKQALETVQRLLPVLCQDHGLTPDQVVAIANNNGGKQALETVQRLLPVLCQDHGLTPAQVVAIASNIGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 302 - DNA, 2805 bp, Artificial Sequence
  Description of Artificial Sequence: Synthetic polynucleotide
atggactacaaagaccatgacggtgattataaagatcatgacatcgattacaaggatgacgatgacaagatggcccccaagaagaagaggaaggtgggcattcaccgcggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgaatggcgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatgggctgaccccagaccaggtagtcgcaatcgcgtcgaacattgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctccaacggtggcggtaagcaggcgctggaaacagtacagcgcctgctgcctgtactgtgccaggatcatggtttgaccccagaccaggtagtcgcaatcgccaacaataacgggggaaagcaagccctggaaaccgtgcaaaggttgttgccggtcctttgtcaagaccacggccttacgcctgcacaagtggtcgccatcgcctccaatattggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggtgaagagcgagctggaggagaagaagtccgagctgcggcacaagctgaagtacgtgccccacgagtacatcgagctgatcgagatcgccaggaacagcacccaggaccgcatcctggagatgaaggtgatggagttcttcatgaaggtgtacggctacaggggaaagcacctgggcggaagcagaaagcctgacggcgccatctatacagtgggcagccccatcgattacggcgtgatcgtggacacaaaggcctacagcggcggctacaatctgcctatcggccaggccgacgagatgcagagatacgtggaggagaaccagacccggaataagcacatcaaccccaacgagtggtggaaggtgtaccctagcagcgtgaccgagttcaagttcctgttcgtgagcggccacttcaagggcaactacaaggcccagctgaccaggctgaaccacatcaccaactgcaatggcgccgtgctgagcgtggaggagctgctgatcggcggcgagatgatcaaagccggcaccctgacactggaggaggtgcggcgcaagttcaacaacggcgagatcaacttcagatct

SEQ ID NO: 303 - DNA, 8245 bp, Artificial Sequence
  Description of Artificial Sequence: Synthetic polynucleotide
taatacgactcactatagggagacccaagctggctagcttaagctgatccactagtccagtgtggtggaattcgctagcgccaccatggcccccaagaagaagaggaaggtgggaatcgatggggtacccgccgctgtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccggcgttggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagcctcgcagcgttgggaccgtatcctccaggcatcagggatgaaaagggccaaaccgtcccctacttcaactcaaacgccggaccaggcgtctttgcatgcattcgccgattcgctggagcgtgaccttgatgcgcccagcccaacgcacgagggagatcagaggcgggcaagcagccgtaaacggtcccgatcggatcgtgctgtcaccggtccctccgcacagcaatcgttcgaggtgcgcgctcccgaacagcgcgatgcgctgcatttgcccctcagttggagggtaaaacgcccgcgtaccagtatcgggggcggcctcccggatcctggtacgcccacggctgccgacctggcagcgtccagcaccgtgatgcgggaacaagatgaggaccccttcgcaggggcagcggatgatttcccggcattcaacgaagaggagctcgcatggttgatggagctattgcctcaggaccgcggccgcgcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtggcggccgcgactacaaggacgacgatgacaagtaagcttctcgagtctagctagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaat

SEQ ID NO: 304 - protein, 1105 aa, Artificial Sequence
  Description of Artificial Sequence: Synthetic polypeptide
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNNGGKQALETVQRLLPVLCQAHGLTPQQVVAIASNNGGKQALETVQRLLPVLCQAHGLTPQQVVAIASNIGGKQALETVQRLLPVLCQAHGLTPEQVVAIASNNGGKQALETVQRLLPVLCQAHGLTPEQVVAIASHDGGKQALETVQALLPVLCQAHGLTPEQVVAIASHDGGKQALETVQALLPVLCQAHGLTPEQVVAIASNIGGKQALETVQALLPVLCQAHGLTPEQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNNGGKQALETVQALLPVLCQAHGLTPEQVVAIASNKGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNNGGKQALETVQRLLPVLCQAHGLTPQQVVAIASNKGGRPALETVQRLLPVLCQAHGLTPEQVVAIASNNGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRAPEQRDALHLPLSWRVKRPRTSIGGGLPDPGTPTAADLAASSTVMREQDEDPFAGAADDFPAFNEEELAWLMELLPQDRGRAPPTDVSLGDELHLDGEDVAMAHADALDDFDLDMLGDGDSPGPGFTPHDSAPYGALDMADFEFEQMFTDALGIDEYGGGRDYKDDDDK

SEQ ID NO: 305 - DNA, 3315 bp, Artificial Sequence
  Description of Artificial Sequence: Synthetic polynucleotide
atggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaaccttactcccgaacaagtagtagcgatagccagtaataacggaggtaaacaagccttggagacggtccaaaggttgctcccggtcttgtgtcaggcacatgggctgacgcctcaacaggtcgtcgcgatagcgtctaataatggaggaaagcaagctctggaaaccgtccagcgactccttccggttctgtgccaggctcatggtctgactccgcagcaagtcgttgctatagcgtccaacatcggaggcaaacaggccctggagaccgtgcagcggttgttgcctgtgctttgccaagcccacgggcttacgcctgagcaagtggtggcgattgccagtaacaacggcggcaaacaagcccttgagactgtgcagaggctcttgccggtactctgccaagcacacggcttgacccccgagcaggttgtagccatagctagtcacgacgggggtaagcaagcgttggaaacggtgcaagcacttctccccgttctctgtcaagcgcatggacttaccccggaacaggtggtcgccattgcaagccatgatggaggaaagcaggcgctcgaaacagtccaggcacttttgcccgtactttgtcaagctcacggtctcaccccggaacaggtggtagccattgcatctaacatcggaggtaagcaagcattggaaacggttcaggccctgttgcctgtactttgccaggcgcacggtctgacacctgagcaggttgtcgccatcgctagcaacggaggtgggaaacaggcacttgaaactgtgcagaggcttctgccggtgctgtgccaagcgcatggccttacacccgagcaagtagtggctattgcgagtcatgatggaggcaagcaagcgctggagactgtccaacgacttcttccggtcttgtgtcaggcacatggattgacccctcaacaagtcgtggcgatagctagcaacggcggtggaaaacaggccctcgaaaccgtccagcgactgctccccgtactgtgtcaagcccatggacttaccccagaacaagttgtggcgattgcctctaacaatggtgggaagcaagctcttgagacggtgcaggcgttgttgcccgtgctttgtcaagctcacgggctcacgccagagcaagtggtcgctatcgcgagtaataaagggggcaaacaagccttggagacagtgcaaaggctcctgccagtgctctgccaggctcatggtttgacacccgaacaggtagttgcaatagcgagtcatgatggcggaaagcaagctcttgaaactgtgcagcggctgttgcctgtactgtgtcaagcccacgggctgacaccggaacaagttgtagcgatcgctagccacgatggcgggaaacaagctctggaaacggtacagagactcctcccagtgctttgtcaggcacacggcctcacgccagagcaggttgtcgccatcgcgtcaaacaatggtggaaagcaggccctggagacagtccaacggttgctgccggtcctttgccaggctcacgggttgaccccccagcaggtcgtggccattgcctcaaacaagggcggtaggccagcattggagacggtgcagaggcttctgcctgtgctctgccaagcgcatggactcacccccgagcaagtggttgctatcgcaagtaacaacggagggaaacaagcgctcgaaaccgtgcaaaggttgctccccgttctctgtcaggcgcacggtcttacgccacaacaggtggtggcgattgcatctaatggaggcggacgccctgccttggagagcattgtggcccagctgtccaggccggaccctgccctggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagcctcgcagcgttgggaccgtatcctccaggcatcagggatgaaaagggccaaaccgtcccctacttcaactcaaacgccggaccaggcgtctttgcatgcattcgccgattcgctggagcgtgaccttgatgcgcccagcccaacgcacgagggagatcagaggcgggcaagcagccgtaaacggtcccgatcggatcgtgctgtcaccggtccctccgcacagcaatcgttcgaggtgcgcgctcccgaacagcgcgatgcgctgcatttgcccctcagttggagggtaaaacgcccgcgtaccagtatcgggggcggcctcccggatcctggtacgcccacggctgccgacctggcagcgtccagcaccgtgatgcgggaacaagatgaggaccccttcgcaggggcagcggatgatttcccggcattcaacgaagaggagctcgcatggttgatggagctattgcctcaggaccgcggccgcgcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtggcggccgcgactacaaggacgacgatgacaag

SEQ ID NO: 306 - protein, 939 aa, Artificial Sequence
  Description of Artificial Sequence: Synthetic polypeptide
MAPKKKRKVGIDGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNNGGKQALETVQRLLPVLCQAHGLTPQQVVAIASNNGGKQALETVQRLLPVLCQAHGLTPQQVVAIASNIGGKQALETVQRLLPVLCQAHGLTPEQVVAIASNNGGKQALETVQRLLPVLCQAHGLTPEQVVAIASHDGGKQALETVQALLPVLCQAHGLTPEQVVAIASHDGGKQALETVQALLPVLCQAHGLTPEQVVAIASNIGGKQALETVQALLPVLCQAHGLTPEQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNNGGKQALETVQALLPVLCQAHGLTPEQVVAIASNKGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNNGGKQALETVQRLLPVLCQAHGLTPQQVVAIASNKGGRPALETVQRLLPVLCQAHGLTPEQVVAIASNNGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSGSRGRAPPTDVSLGDELHLDGEDVAMAHADALDDFDLDMLGDGDSPGPGFTPHDSAPYGALDMADFEFEQMFTDALGIDEYGGGRDYKDDDDK

SEQ ID NO: 307 - DNA, 2817 bp, Artificial Sequence
  Description of Artificial Sequence: Synthetic polynucleotide
atggcccccaagaagaagaggaaggtgggaatcgatggggtacccgccgctgtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaaccttactcccgaacaagtagtagcgatagccagtaataacggaggtaaacaagccttggagacggtccaaaggttgctcccggtcttgtgtcaggcacatgggctgacgcctcaacaggtcgtcgcgatagcgtctaataatggaggaaagcaagctctggaaaccgtccagcgactccttccggttctgtgccaggctcatggtctgactccgcagcaagtcgttgctatagcgtccaacatcggaggcaaacaggccctggagaccgtgcagcggttgttgcctgtgctttgccaagcccacgggcttacgcctgagcaagtggtggcgattgccagtaacaacggcggcaaacaagcccttgagactgtgcagaggctcttgccggtactctgccaagcacacggcttgacccccgagcaggttgtagccatagctagtcacgacgggggtaagcaagcgttggaaacggtgcaagcacttctccccgttctctgtcaagcgcatggacttaccccggaacaggtggtcgccattgcaagccatgatggaggaaagcaggcgctcgaaacagtccaggcacttttgcccgtactttgtcaagctcacggtctcaccccggaacaggtggtagccattgcatctaacatcggaggtaagcaagcattggaaacggttcaggccctgttgcctgtactttgccaggcgcacggtctgacacctgagcaggttgtcgccatcgctagcaacggaggtgggaaacaggcacttgaaactgtgcagaggcttctgccggtgctgtgccaagcgcatggccttacacccgagcaagtagtggctattgcgagtcatgatggaggcaagcaagcgctggagactgtccaacgacttcttccggtcttgtgtcaggcacatggattgacccctcaacaagtcgtggcgatagctagcaacggcggtggaaaacaggccctcgaaaccgtccagcgactgctccccgtactgtgtcaagcccatggacttaccccagaacaagttgtggcgattgcctctaacaatggtgggaagcaagctcttgagacggtgcaggcgttgttgcccgtgctttgtcaagctcacgggctcacgccagagcaagtggtcgctatcgcgagtaataaagggggcaaacaagccttggagacagtgcaaaggctcctgccagtgctctgccaggctcatggtttgacacccgaacaggtagttgcaatagcgagtcatgatggcggaaagcaagctcttgaaactgtgcagcggctgttgcctgtactgtgtcaagcccacgggctgacaccggaacaagttgtagcgatcgctagccacgatggcgggaaacaagctctggaaacggtacagagactcctcccagtgctttgtcaggcacacggcctcacgccagagcaggttgtcgccatcgcgtcaaacaatggtggaaagcaggccctggagacagtccaacggttgctgccggtcctttgccaggctcacgggttgaccccccagcaggtcgtggccattgcctcaaacaagggcggtaggccagcattggagacggtgcagaggcttctgcctgtgctctgccaagcgcatggactcacccccgagcaagtggttgctatcgcaagtaacaacggagggaaacaagcgctcgaaaccgtgcaaaggttgctccccgttctctgtcaggcgcacggtcttacgccacaacaggtggtggcgattgcatctaatggaggcggacgccctgccttggagagcattgtggcccagctgtccaggccggaccctgccctggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcggatcccgcggccgcgcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtggcggccgcgactacaaggacgacgatgacaag

SEQ ID NO: 308 - protein, 949 aa, Artificial Sequence
  Description of Artificial Sequence: Synthetic polypeptide
MAPKKKRKVGIDGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRAPEQRDALHLPLSWRVKRPRTSIGGGLPDPGTPTAADLAASSTVMREQDEDPFAGAADDFPAFNEEELAWLMELLPQDRGRAPPTDVSLGDELHLDGEDVAMAHADALDDFDLDMLGDGDSPGPGFTPHDSAPYGALDMADFEFEQMFTDALGIDEYGGGRDYKDDDDK

SEQ ID NO: 309 - DNA, 2847 bp, Artificial Sequence
  Description of Artificial Sequence: Synthetic polynucleotide
atggcccccaagaagaagaggaaggtgggaatcgatggggtacccgccgctgtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccggcgttggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagcctcgcagcgttgggaccgtatcctccaggcatcagggatgaaaagggccaaaccgtcccctacttcaactcaaacgccggaccaggcgtctttgcatgcattcgccgattcgctggagcgtgaccttgatgcgcccagcccaacgcacgagggagatcagaggcgggcaagcagccgtaaacggtcccgatcggatcgtgctgtcaccggtccctccgcacagcaatcgttcgaggtgcgcgctcccgaacagcgcgatgcgctgcatttgcccctcagttggagggtaaaacgcccgcgtaccagtatcgggggcggcctcccggatcctggtacgcccacggctgccgacctggcagcgtccagcaccgtgatgcgggaacaagatgaggaccccttcgcaggggcagcggatgatttcccggcattcaacgaagaggagctcgcatggttgatggagctattgcctcaggaccgcggccgcgcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtggcggccgcgactacaaggacgacgatgacaag

SEQ ID NO: 310 - protein, 791 aa, Artificial Sequence
  Description of Artificial Sequence: Synthetic polypeptide
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGGSGHRGRAPPTDVSLGDELHLDGEDVAMAHADALDDFDLDMLGDGDSPGPGFTPHDSAPYGALDMADFEFEQMFTDALGIDEYGGGRDYKDDDDK

SEQ ID NO: 311 - DNA, 2373 bp, Artificial Sequence
  Description of Artificial Sequence: Synthetic polynucleotide
atggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccggcgttggccgcgttgaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagcctcgcagcgttgggaccgtatcctccaggcatcggggggatccggccaccgcggccgcgcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtggcggccgcgactacaaggacgacgatgacaag

SEQ ID NO: 312 - protein, 751 aa, Artificial Sequence
  Description of Artificial Sequence: Synthetic polypeptide
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSGSRGRAPPTDVSLGDELHLDGEDVAMAHADALDDFDLDMLGDGDSPGPGFTPHDSAPYGALDMADFEFEQMFTDALGIDEYGGGRDYKDDDDK

SEQ ID NO: 313 - DNA, 2253 bp, Artificial Sequence
  Description of Artificial Sequence: Synthetic polynucleotide
atggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccggcgttggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcggatcccgcggccgcgcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtggcggccgcgactacaaggacgacgatgacaag

SEQ ID NO: 314 - protein, 679 aa, Artificial Sequence
  Description of Artificial Sequence: Synthetic polypeptide
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVAGSRGRAPPTDVSLGDELHLDGEDVAMAHADALDDFDLDMLGDGDSPGPGFTPHDSAPYGALDMADFEFEQMFTDALGIDEYGGGRDYKDDDDK

SEQ ID NO: 315 - DNA, 2037 bp, Artificial Sequence
  Description of Artificial Sequence: Synthetic polynucleotide
atggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccggcgttggccgcgttaaccaacgaccacctcgtcgccggatcccgcggccgcgcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtggcggccgcgactacaaggacgacgatgacaag

SEQ ID NO: 316 - protein, 493 aa, Artificial Sequence
  Description of Artificial Sequence: Synthetic polypeptide
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRAPEQRDALHLPLSWRVKRPRTSIGGGLPDPGTPTAADLAASSTVMREQDEDPFAGAADDFPAFNEEELAWLMELLPQDRGRAPPTDVSLGDELHLDGEDVAMAHADALDDFDLDMLGDGDSPGPGFTPHDSAPYGALDMADFEFEQMFTDALGIDEYGGGRDYKDDDDK

SEQ ID NO: 317 - DNA, 1479 bp, Artificial Sequence
  Description of Artificial Sequence: Synthetic polynucleotide
atggtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagcctcgcagcgttgggaccgtatcctccaggcatcagggatgaaaagggccaaaccgtcccctacttcaactcaaacgccggaccaggcgtctttgcatgcattcgccgattcgctggagcgtgaccttgatgcgcccagcccaacgcacgagggagatcagaggcgggcaagcagccgtaaacggtcccgatcggatcgtgctgtcaccggtccctccgcacagcaatcgttcgaggtgcgcgctcccgaacagcgcgatgcgctgcatttgcccctcagttggagggtaaaacgcccgcgtaccagtatcgggggcggcctcccggatcctggtacgcccacggctgccgacctggcagcgtccagcaccgtgatgcgggaacaagatgaggaccccttcgcaggggcagcggatgatttcccggcattcaacgaagaggagctcgcatggttgatggagctattgcctcaggaccgcggccgcgcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtggcggccgcgactacaaggacgacgatgacaag

SEQ ID NO: 318 - DNA, 5914 bp, Artificial Sequence; identical to SEQ ID NO: 176
  Description of Artificial Sequence: Synthetic polynucleotide

SEQ ID NO: 319 - DNA, 5052 bp, Artificial Sequence
  Description of Artificial Sequence: Synthetic polynucleotide
ggtaccgagctcttacgcgtgctagtataaataccttctgccttactagtataaataccttctgccttgctagctcgagatctgcgatctgcatctcaattagtcagcaaccatagtcccgcccctaactccgcccatcccgcccctaactccgcccagttccgcccattctccgccccatcgctgactaattttttttatttatgcagaggccgaggccgcctcggcctctgagctattccagaagtagtgaggaggcttttttggaggcctaggcttttgcaaaaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagagtcggggcggccggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataaggatccgtcgaccgatgcccttgagagccttcaacccagtcagctccttccggtgggcgcggggcatgactatcgtcgccgcacttatgactgtcttctttatcatgcaactcgtaggacaggtgccggcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttgccattcgccattcaggctgcgcaactgttgggaagggcgatcggtgcgggcctcttcgctattacgccagcccaagctaccatgataagtaagtaatattaaggtacgggaggtacttggagcggccgcaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctctatcgata

SEQ ID NO: 320 - DNA, 2520 bp, Artificial Sequence
  Description of Artificial Sequence: Synthetic polynucleotide
gtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgcccccctgaacctgaccccggagcaggtggtggccatcgccagcaatattggtggcaagcaggcgctggagacggtgcagcggctgttgccggtgctgtgccaggcccatggcctgaccccggagcaggtggtggccatcgccagcaatggcggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggagcaggtggtggccatcgccagcaatattggtggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgcgccaggcccatggcctgaccccggagcaggtcgtggccatcgccagcaatggcggcaagcaggcgctggagacggtgcagcggctgttgccggtgctgtgccaggcccatggcctgaccccggcacaggtggtggccatcgccagcaatattggcggcaagcaggcgctggagacggtgcagcggctgttgccggtgctgtgccaggcccatggcctgaccccggagcaggtcgtggccatcgccagccacgatggcggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggaccaggtggtggccatcgccagcaatggcggtggcaagcaggcgctggagacggtgcagcggctgttgccggtgctgtgccaggcccatggcctgaccccggagcaggtggtggccatcgccagccacgatggcggcaagcaggcgctggagacggtgcagcggctgttgccggtgctgtgccaggcccatggcctgaccccggagcaggtggtggccatcgccagcaatggcggcggcaggccggcgctggagagcattgttgcccagttatctcgccctgatccggcgttggccgcgttgaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagcctcgcagcgttgggaccgtatcctccaggcatcagggatgaaaagggccaaaccgtcccctacttcaactcaaacgccggaccaggcgtctttgcatgcattcgccgattcgctggagcgtgaccttgatgcgcccagcccaacgcacgagggagatcagaggcgggcaagcagccgtaaacggtcccgatcggatcgtgctgtcaccggtccctccgcacagcaatcgttcgaggtgcgcgctcccgaacagcgcgatgcgctgcatttgcccctcagttggagggtaaaacgcccgcgtaccagtatcgggggcggcctcccggatcctggtacgcccacggctgccgacctggcagcgtccagcaccgtgatgcgggaacaagatgaggaccccttcgcaggggcagcggatgatttcccggcattcaacgaagaggagctcgcatggttgatggagctattgcctcag

SEQ ID NO: 321 - protein, 693 aa, Artificial Sequence
  Description of Artificial Sequence: Synthetic polypeptide
VDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNIGGKQALETVQRLLPVLCQAHGLTPEQVVAIASNNGGKQALETVQRLLPVLCQAHGLTPEQVVAIASHDGGKQALETVQALLPVLCQAHGLTPEQVVAIASHDGGKQALETVQALLPVLCQAHGLTPEQVVAIASHDGGKQALETVQALLPVLCQAHGLTPEQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMS

SEQ ID NO: 322 - DNA, 2079 bp, Artificial Sequence
  Description of Artificial Sequence: Synthetic polynucleotide
gtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaacctgacgcctcaacaggtcgtcgcgatagcgtctaataatggaggaaagcaagctctggaaaccgtccagcgactccttccggttctgtgccaggctcatggtctgactccgcagcaagtcgttgctatagcgtccaacatcggaggcaaacaggccctggagaccgtgcagcggttgttgcctgtgctttgccaagcccacgggcttacgcctgagcaagtggtggcgattgccagtaacaacggcggcaaacaagcccttgagactgtgcagaggctcttgccggtactctgccaagcacacggcttgacccccgagcaggttgtagccatagctagtcacgacgggggtaagcaagcgttggaaacggtgcaagcacttctccccgttctctgtcaagcgcatggacttaccccggaacaggtggtcgccattgcaagccatgatgggggtaagcaagcgttggaaacggtgcaagcacttctccccgttctctgtcaagcgcatggacttaccccggaacaggtggtcgccattgcaagccatgatggaggaaagcaggcgctcgaaacagtccaggcacttttgcccgtactttgtcaagctcacggtctcaccccggaacaggtggtagccattgcatctaacggagggggcaaacaagccttggagacagtgcaaaggctcctgccagtgctctgccaggctcatggtttgacacccgaacaggtagttgcaatagcgagtcatgatggcggaaagcaagctcttgaaactgtgcagcggctgttgcctgtactgtgtcaagcccacgggctgacaccggaacaagttgtagcgatcgctagccacgatggcgggaaacaagctctggaaacggtacagagactcctcccagtgctttgtcaggcacacggcctcacgccagagcaggttgtcgccatcgcgtcacatgatgggggcaaacaagccttggagacagtgcaaaggctcctgccagtgctctgccaggctcatggtttgacacccgaacaggtagttgcaatagcgagtcatgatggcggaaagcaagctcttgaaactgtgcagcggctgttgcctgtactgtgtcaagcccacgggctgacaccggaacaagttgtagcgatcgctagccacgatggcgggaaacaagctctggaaacggtacagagactcctcccagtgctttgtcaggcacacggcctcacgccagagcaggttgtcgccatcgcgtcaaacggtggagggaaacaagcgctcgaaaccgtgcaaaggttgctccccgttctctgtcaggcgcacggtcttacgccacaacaggtggtggcgattgcatctaatggaggcggacgccctgccttggagagcattgtggcccagctgtccaggccggaccctgccctggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagc

SEQ ID NO: 323 - protein, 659 aa, Artificial Sequence
  Description of Artificial Sequence: Synthetic polypeptide
VDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNKGGKQALETVQALLPVLCQAHGLTPEQVVAIASHDGGKQALETVQALLPVLCQAHGLTPEQVVAIASNGGGKQALETVQRLLPVLCQAHGLTPEQVVAIASHDGGKQALETVQRLLPVLCQAHGLTPEQVVAIASNGGGKQALETVQALLPVLCQAHGLTPEQVVAIASNGGGKQALETVQRLLPVLCQAHGLTPEQVVAIASHDGGKQALETVQRLLPVLCQAHGLTPQQVVAIASNIGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMS

SEQ ID NO: 324 - DNA, 1977 bp, Artificial Sequence
  Description of Artificial Sequence: Synthetic polynucleotide
gtggatctacgcacgctcggctacagccagcagcaacaggagaagatcaaaccgaaggttcgttcgacagtggcgcagcaccacgaggcactggtcggccatgggtttacacacgcgcacatcgttgcgctcagccaacacccggcagcgttagggaccgtcgctgtcaagtatcaggacatgatcgcagcgttgccagaggcgacacacgaagcgatcgttggcgtcggcaaacagtggtccggcgcacgcgccctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggggcccccctgaaccttacacccgagcaagtagtggctattgcgagtaataaagggggtaagcaagcgttggaaacggtgcaagcacttctccccgttctctgtcaagcgcatggacttaccccggaacaggtggtcgccattgcaagccatgatggaggaaagcaggcgctcgaaacagtccaggcacttttgcccgtactttgtcaagctcacggtctcaccccggaacaggtggtagccattgcatctaacggagggggcaaacaagccttggagacagtgcaaaggctcctgccagtgctctgccaggctcatggtttgacacccgaacaggtagttgcaatagcgagtcatgatggcggaaagcaagctcttgaaactgtgcagcggctgttgcctgtactgtgtcaagcccacgggctgacaccggaacaagttgtagcgatcgctagcaacggcggaggtaagcaagcattggaaacggttcaggccctgttgcctgtactttgccaggcgcacggtctgacacctgagcaggttgtcgccatcgctagcaacggaggtgggaaacaggcacttgaaactgtgcagaggcttctgccggtgctgtgccaagcgcatggccttacacccgagcaagtagtggctattgcgagtcatgatggaggcaagcaagcgctggagactgtccaacgacttcttccggtcttgtgtcaggcacatggattgacccctcaacaagtcgtggcgatagctagcaacatcggaggcaaacaggccctggagaccgtgcagcggttgttgcctgtgctttgccaagcccacgggcttacgcctgagcaagtggtggcgattgccagtaacaacgggggcaaacaagccttggagacagtgcaaaggctcctgccagtgctctgccaggctcatggtttgacacccgaacaggtagttgcaatagcgagtcatgatggcggaaagcaagctcttgaaactgtgcagcggctgttgcctgtactgtgtcaagcccacgggctgacaccggaacaagttgtagcgatcgctagccacgatggcgggaaacaagctctggaaacggtacagagactcctcccagtgctttgtcaggcacacggcctcacgccagagcaggttgtcgccatcgcgtcaaacggtggagggaaacaagcgctcgaaaccgtgcaaaggttgctccccgttctctgtcaggcgcacggtcttacgccacaacaggtggtggcgattgcatctaatggaggcggacgccctgccttggagagcattgtggcccagctgtccaggccggaccctgccctggccgcgttaaccaacgaccacctcgtcgccttggcctgcctcggcggacgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagc

SEQ ID NO: 325 - protein, 1003 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASHDGGKQALETVQRLLPVLCQDHGLTPDQVVAIASNGGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASHDGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASHDGGKQALETVQRLLPVLCQDHGLTPDQVVAIASNIGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIANNNGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 326 - protein, 1003 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGLTPEQVVAIASNGGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNGGGKQALETVQRLLPVLCQDHGLTPDQVVAIANNNGGKQALETVQRLLPVLCQAHGLTPDQVVAIASNGGGKQALETVQRLLPVLCQAHGLTPAQVVAIASHDGGKQALETVQRLLPVLCQDHGLTPDQVVAIASNIGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIASHDGGKQALETVQRLLPVLCQAHGLTPAQVVAIASHDGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 327 - protein, 935 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGLTPEQVVAIASHDGGKQALETVQRLLPVLCQAHGLTPDQVVAIASNIGGKQALETVQRLLPVLCQAHGLTPAQVVAIANNNGGKQALETVQRLLPVLCQDHGLTPDQVVAIASHDGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASNIGGKQALETVQRLLPVLCQDHGLTPEQVVAIASNGGGKQALETVQRLLPVLCQAHGLTPDQVVAIANNNGGKQALETVQRLLPVLCQAHGLTPAQVVAIANNNGGKQALETVQRLLPVLCQDHGLTPDQVVAIASNIGGKQALETVQRLLPVLCQDHGLTPAQVVAIASNIGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 328 - protein, 1003 aa, Artificial Sequence
  Description of Artificial Sequence: Synthetic polypeptide
MDYKDHDGDYKDHDIDYKDDDDKMAPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIASNGGGKQALETVQRLLPVLCQDHGLTPDQVVAIASNGGGKQALETVQRLLPVLCQDHGLTPEQVVAIASHDGGKQALETVQRLLPVLCQAHGLTPDQVVAIASHDGGKQALETVQRLLPVLCQAHGLTPAQVVAIASNIGGKQALETVQRLLPVLCQDHGLTPDQVVAIASNIGGKQALETVQRLLPVLCQDHGLTPEQVVAIASHDGGKQALETVQRLLPVLCQAHGLTPDQVVAIASNGGGKQALETVQRLLPVLCQAHGLTPAQVVAIANNNGGKQALETVQRLLPVLCQDHGLTPDQVVAIASHDGGKQALETVQRLLPVLCQDHGLTPEQVVAIASNIGGKQALETVQRLLPVLCQAHGLTPDQVVAIASNIGGKQALETVQRLLPVLCQAHGLTPAQVVAIASNIGGKQALETVQRLLPVLCQDHGLTPEQVVAIASNGGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 329 - DNA, 16 bp, Artificial Sequence
  Description of Artificial Sequence: Synthetic oligonucleotide
gaccctgcctgctcct

SEQ ID NO: 330 - DNA, 17 bp, Artificial Sequence
  Description of Artificial Sequence: Synthetic oligonucleotide
cacctgcagctgcccag

SEQ ID NO: 331 - DNA, 15 bp, Artificial Sequence
  Description of Artificial Sequence: Synthetic oligonucleotide
ggcccttgcagccgt

SEQ ID NO: 332 - DNA, 14 bp, Artificial Sequence
  Description of Artificial Sequence: Synthetic oligonucleotide
cagacgctggcact

SEQ ID NO: 333 - protein, 34 aa, Xanthomonas sp.; identical to SEQ ID NO: 18

SEQ ID NO: 334 - protein, 34 aa, Artificial Sequence
  Description of Artificial Sequence: Synthetic polypeptide
LTPDQVVAIASHDGGKQALEAVRALLPVLCQDHG

SEQ ID NO: 335 - protein, 34 aa, Artificial Sequence
  Description of Artificial Sequence: Synthetic polypeptide
LTPDQVVAIASHDGGKQALEAVRAQLPVLCQDHG

SEQ ID NO: 336 - protein, 34 aa, Artificial Sequence
  Description of Artificial Sequence: Synthetic polypeptide
LTPDQVVAIASHDGGKQALEAVWALLPVLCQDHG

SEQ ID NO: 337 - protein, 34 aa, Artificial Sequence
  Description of Artificial Sequence: Synthetic polypeptide
LTPDQVVAIASHDGGKPALEAVWAKLPVLCQDHG

SEQ ID NO: 338 - protein, 34 aa, Artificial Sequence
  Description of Artificial Sequence: Synthetic polypeptide
LSTAQVVAIASHDGGKQALETVQRLLPVLCQDHG

SEQ ID NO: 339 - protein, 34 aa, Artificial Sequence
  Description of Artificial Sequence: Synthetic polypeptide
LTPDQVVAIASHDGGKQALEAVRALFPDLCQDHG

SEQ ID NO: 340 - protein, 34 aa, Artificial Sequence
  Description of Artificial Sequence: Synthetic polypeptide
LTPDQVVAIASHDGGKQALETVQRLLPVLRQDHG

SEQ ID NO: 341 - protein, 34 aa, Artificial Sequence
  Description of Artificial Sequence: Synthetic polypeptide
LSTAQVVAIASHDGGKQALEAVRAQLPVLRGAHG

SEQ ID NO: 342 - DNA, 400 bp, Artificial Sequence
  Description of Artificial Sequence: Synthetic polynucleotide
ctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaagatggccgcgaattcgcccttaatgatacggcgaccaccgagatctacactctttccctacacgacgctcttccgatctggagccatctggccgggttggctggttataaccgcgcagattctgttcacgggactcagagttgaagctcctctcccttccgaacagctccgcgcaccgccccgcgacgcagcccggcgca

SEQ ID NO: 343 - DNA, 71 bp, Artificial Sequence
  Description of Artificial Sequence: Synthetic oligonucleotide
cgcggagccatctggccgggttggctggttataaccgcgcagattctgttcacgggactcagagttgaagc

SEQ ID NO: 344 - DNA, 68 bp, Artificial Sequence
  Description of Artificial Sequence: Synthetic oligonucleotide
cgcggagccatctggccgggttggctgataaccgcgcagattctgttcacgggactcagagttgaagc

SEQ ID NO: 345 - DNA, 67 bp, Artificial Sequence
  Description of Artificial Sequence: Synthetic oligonucleotide
cgcggagccatctggccgggttggctgtaaccgcgcagattctgttcacgggactcagagttgaagc

SEQ ID NO: 346 - DNA, 67 bp, Artificial Sequence
  Description of Artificial Sequence: Synthetic oligonucleotide
cgcggagccatctggccgggttggttataaccgcgcagattctgttcacgggactcagagttgaagc

SEQ ID NO: 347 - DNA, 58 bp, Artificial Sequence
  Description of Artificial Sequence: Synthetic oligonucleotide
cgcggagccatctggttataaccgcgcagattctgttcacgggactcagagttgaagc

SEQ ID NO: 348 - DNA, 58 bp, Artificial Sequence
  Description of Artificial Sequence: Synthetic oligonucleotide
cgcggagccatctggccgggttggcgcagattctgttcacgggactcagagttgaagc

SEQ ID NO: 349 - DNA, 52 bp, Artificial Sequence
  Description of Artificial Sequence: Synthetic oligonucleotide
cgcggagccatctggccgcgcagattctgttcacgggactcagagttgaagc

SEQ ID NO: 350 - DNA, 40 bp, Artificial Sequence
  Description of Artificial Sequence: Synthetic oligonucleotide
cgcggagccatctggccgggacgggactcagagttgaagc

SEQ ID NO: 351 - DNA, 52 bp, Artificial Sequence
  Description of Artificial Sequence: Synthetic oligonucleotide
gcggagccatctggccgggttggctggttataaccgcgcagattctgttcac

SEQ ID NO: 352 - DNA, 33 bp, Artificial Sequence; identical to SEQ ID NO: 88
  Description of Artificial Sequence: Synthetic oligonucleotide

SEQ ID NO: 353 - DNA, 52 bp, Artificial Sequence; identical to SEQ ID NO: 351
  Description of Artificial Sequence: Synthetic oligonucleotide

SEQ ID NO: 354 - DNA, 33 bp, Artificial Sequence; identical to SEQ ID NO: 90
  Description of Artificial Sequence: Synthetic oligonucleotide

SEQ ID NO: 355 - DNA, 49 bp, Artificial Sequence
  Description of Artificial Sequence: Synthetic oligonucleotide
atccaagcttcgtcgacctagccctggttataaccgcgcagattctgtt

SEQ ID NO: 356 - DNA, 49 bp, Artificial Sequence; identical to SEQ ID NO: 355
  Description of Artificial Sequence: Synthetic oligonucleotide

SEQ ID NO: 357 - DNA, 37 bp, Artificial Sequence
  Description of Artificial Sequence: Synthetic oligonucleotide
atccaagcttcgtcgacctagccgcgcagattctgtt

SEQ ID NO: 358 - DNA, 48 bp, Artificial Sequence
  Description of Artificial Sequence: Synthetic oligonucleotide
atccaagcttcgtcgacctagcctggttataaccgcgcagattctgtt

SEQ ID NO: 359 - DNA, 46 bp, Artificial Sequence
  Description of Artificial Sequence: Synthetic oligonucleotide
atccaagcttcgtcgacctagcctggttaaccgcgcagattctgtt

SEQ ID NO: 360 - DNA, 47 bp, Artificial Sequence
  Description of Artificial Sequence: Synthetic oligonucleotide
atccaagcttcgtcgacctagcctggtataaccgcgcagattctgtt

SEQ ID NO: 361 - DNA, 43 bp, Artificial Sequence
  Description of Artificial Sequence: Synthetic oligonucleotide
atccaagcttcgtcgacctagcctggtgtacgcagattctgtt

SEQ ID NO: 362 - DNA, 43 bp, Artificial Sequence
  Description of Artificial Sequence: Synthetic oligonucleotide
atccaagcttcgtcgacctggttataaccgcgcagattctgtt

SEQ ID NO: 363 - protein, 137 aa, Xanthomonas sp.
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLN

SEQ ID NO: 364 - protein, 121 aa, Xanthomonas sp.
IKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLN

SEQ ID NO: 365 - protein, 72 aa, Xanthomonas sp.
LTPEQVVAIASNGGGRPALESIVAQLSRPDPALAALTNDHLVALACLGGRPALDAVKKGLPHAPALIKRTNR

SEQ ID NO: 366 - protein, 41 aa, Xanthomonas sp.
LTPEQVVAIASNGGGRPALESIVAQLSRPDPALAALTNDHL

SEQ ID NO: 367 - protein, 121 aa, Ralstonia sp.
LKQESLAEVAKYHATLAGQGFTHADICRISRRWQSLRVVANNYPELMAALPRLTTAQIVDIARQRSGDLALQALLPVAAALTAAPLGLSASQIATVAQYGERPAIQALYRLRRKLTRAPLG

SEQ ID NO: 368 - protein, 40 aa, Ralstonia sp.
LSIAQVIAIACIGGRQALTAIEMHMLALRAAPYNLSPERV

SEQ ID NO: 369 - protein, 119 aa, Xanthomonas campestris
LTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGL

SEQ ID NO: 370 - DNA, 15 bp, Homo sapiens
gctggtcatcctcat

SEQ ID NO: 371 - DNA, 15 bp, Homo sapiens
ggtcatcctcatcct

SEQ ID NO: 372 - DNA, 15 bp, Homo sapiens
catcctcatcctgat

SEQ ID NO: 373 - DNA, 17 bp, Homo sapiens
cctcatcctgataaact

SEQ ID NO: 374 - DNA, 73 bp, Homo sapiens
tggttttgtgggcaacatgctggtcatcctcatcctgataaactgcaaaaggctgaagagcatgactgacatc

SEQ ID NO: 375 - DNA, 73 bp, Homo sapiens
gatgtcagtcatgctcttcagccttttgcagtttatcaggatgaggatgaccagcatgttgcccacaaaacca

SEQ ID NO: 376 - DNA, 15 bp, Homo sapiens
gctcttcagcctttt

SEQ ID NO: 377 - DNA, 13 bp, Homo sapiens
gctcttcagcctt

SEQ ID NO: 378 - DNA, 15 bp, Homo sapiens
catgctcttcagcct

SEQ ID NO: 379 - DNA, 14 bp, Homo sapiens
gtcagtcatgctct

SEQ ID NO: 380 - DNA, 51 bp, Artificial Sequence
  Description of Artificial Sequence: Synthetic oligonucleotide
ttcctgcccagctccatttccttctcctggaactaccagaacaacactgaa

SEQ ID NO: 381 - DNA, 51 bp, Artificial Sequence
  Description of Artificial Sequence: Synthetic oligonucleotide
ttcagtgttgttctggtagttccaggagaaggaaatggagctgggcaggaa

SEQ ID NO: 382 - DNA, 17 bp, Zea maize
ttatttgaagaaactat

SEQ ID NO: 383 - DNA, 15 bp, Zea maize
ttatttgaagaaact

SEQ ID NO: 384 - DNA, 16 bp, Zea maize
tttgaagaactatatt

SEQ ID NO: 385 - DNA, 59 bp, Zea maize
ttatttgaagaaactatattacagagcataagcttatgcaacactcccactagttgatt

SEQ ID NO: 386 - DNA, 59 bp, Zea maize
aatcaactagtgggagtgttgcataagcttatgctctgtaatatagtttcttcaaataa

SEQ ID NO: 387 - DNA, 14 bp, Zea maize
tgggagtgttgcat

SEQ ID NO: 388 - DNA, 18 bp, Zea maize
tggggaggagggcgtgct

SEQ ID NO: 389 - DNA, 60 bp, Zea maize
tggggaggagggcgtgctgcgcgaaggaaggcgttaagagaggggcgtggacgagcaagg

SEQ ID NO: 390 - DNA, 60 bp, Zea maize
ccttgctcgtccacgcccctctcttaacgccttccttcgcgcagcacgccctcctcccca

SEQ ID NO: 391 - DNA, 17 bp, Zea maize
tgaactacctccggccc

SEQ ID NO: 392 - DNA, 18 bp, Zea maize
tcctacgacgaggaggat

SEQ ID NO: 393 - DNA, 74 bp, Zea maize
ctgaactacctccggcccaacatcaggcgcggcaacatctcctacgacgaggaggatctcatgatcatccgcct

SEQ ID NO: 394 - DNA, 74 bp, Zea maize
aggcggatgatcatgagatcctcctcgtcgtaggagatgttgccgcgcctgatgttgggccggaggtagttcag

SEQ ID NO: 395 - DNA, 17 bp, Zea maize
tcctcgtcgtaggagat

SEQ ID NO: 396 - DNA, 23 bp, Zea maize
ccacaggctcctcggcaacaggt

SEQ ID NO: 397 - DNA, 23 bp, Zea maize
acctgttgccgaggagcctgtgg

SEQ ID NO: 398 - DNA, 16 bp, Zea maize
ttgccgaggagcctgt

SEQ ID NO: 399 - protein, 35 aa, Artificial Sequence
  Description of Artificial Sequence: Synthetic polypeptide
  MOD_RES (1)..(11): Any amino acid
  MOD_RES (12)..(13): Any amino acid and these positions are involved in DNA binding
  MOD_RES (14)..(35): Any amino acid and this region may encompass 20 to 22 residues
XXXXXXXXXXXXXXXXXXXXXXXXXXXXXXXXXXX

SEQ ID NO: 400 - protein, 22 aa, Artificial Sequence
  Description of Artificial Sequence: Synthetic peptide
  MOD_RES (1)..(1): Gly or Ser
  MOD_RES (2)..(22): Any amino acid and this region may encompass 19 to 21 residues
XXXXXXXXXXXXXXXXXXXXXX

SEQ ID NO: 401 - protein, 22 aa, Artificial Sequence
  Description of Artificial Sequence: Synthetic peptide
  MOD_RES (1)..(4): Any amino acid and this region may encompass 3 to 4 residues
  MOD_RES (5)..(5): Ala or Thr
  MOD_RES (6)..(22): Any amino acid and this region may encompass 16 to 17 residues
XXXXXXXXXXXXXXXXXXXXXX

SEQ ID NO: 402 - protein, 22 aa, Artificial Sequence
  Description of Artificial Sequence: Synthetic peptide
  MOD_RES (1)..(5): Any amino acid and this region may encompass 4 to 5 residues
  MOD_RES (6)..(6): Leu or Val
  MOD_RES (7)..(22): Any amino acid and this region may encompass 15 to 16 residues
XXXXXXXXXXXXXXXXXXXXXX

SEQ ID NO: 403 - protein, 34 aa, Artificial Sequence
  Description of Artificial Sequence: Synthetic polypeptide
LTPDQVAAIASHDGGKQALETVQRLLPVLCQDHG

SEQ ID NO: 404 - protein, 34 aa, Artificial Sequence
  Description of Artificial Sequence: Synthetic polypeptide
LTPDQVVLIASHDGGKQALETVQRLLPVLCQDHG

SEQ ID NO: 405 - protein, 34 aa, Artificial Sequence
  Description of Artificial Sequence: Synthetic polypeptide
LTPDQVVTIASHDGGKQALETVQRLLPVLCQDHG

SEQ ID NO: 406 - protein, 34 aa, Artificial Sequence
  Description of Artificial Sequence: Synthetic polypeptide
LTPDQVVAAASHDGGKQALETVQRLLPVLCQDHG

SEQ ID NO: 407 - protein, 34 aa, Artificial Sequence
  Description of Artificial Sequence: Synthetic polypeptide
LTPDQVVAVASHDGGKQALETVQRLLPVLCQDHG

SEQ ID NO: 408 - protein, 34 aa, Artificial Sequence
  Description of Artificial Sequence: Synthetic polypeptide
LTPDQVVAILSHDGGKQALETVQRLLPVLCQDHG

SEQ ID NO: 409 - protein, 34 aa, Artificial Sequence
  Description of Artificial Sequence: Synthetic polypeptide
LTPDQVVAIAAHDGGKQALETVQRLLPVLCQDHG

SEQ ID NO: 410 - protein, 34 aa, Artificial Sequence
  Description of Artificial Sequence: Synthetic polypeptide
LTPDQVVAIASHDGGKQALATVQRLLPVLCQDHG

SEQ ID NO: 411 - protein, 34 aa, Artificial Sequence
  Description of Artificial Sequence: Synthetic polypeptide
LTPDQVVAIASHDGGKQALEAVQRLLPVLCQDHG

SEQ ID NO: 412 - protein, 34 aa, Artificial Sequence
  Description of Artificial Sequence: Synthetic polypeptide
LTPDQVVAIASHDGGKQALETAQRLLPVLCQDHG

SEQ ID NO: 413 - protein, 34 aa, Artificial Sequence
  Description of Artificial Sequence: Synthetic polypeptide
LTPDQVVAIASHDGGKQALETVARLLPVLCQDHG

SEQ ID NO: 414 - protein, 34 aa, Artificial Sequence
  Description of Artificial Sequence: Synthetic polypeptide
LTPDQVVAIASHDGGKQALETVRRLLPVLCQDHG

SEQ ID NO: 415 - protein, 34 aa, Artificial Sequence
  Description of Artificial Sequence: Synthetic polypeptide
LTPDQVVAIASHDGGKQALETVKRLLPVLCQDHG

SEQ ID NO: 416 - protein, 34 aa, Artificial Sequence
  Description of Artificial Sequence: Synthetic polypeptide
LTPDQVVAIASHDGGKQALETVWRLLPVLCQDHG

SEQ ID NO: 417 - protein, 34 aa, Artificial Sequence
  Description of Artificial Sequence: Synthetic polypeptide
LTPDQVVAIASHDGGKQALETVQALLPVLCQDHG

SEQ ID NO: 418 - protein, 34 aa, Artificial Sequence
  Description of Artificial Sequence: Synthetic polypeptide
LTPDQVVAIASHDGGKQALETVQRALPVLCQDHG

SEQ ID NO: 419 - protein, 34 aa, Artificial Sequence
  Description of Artificial Sequence: Synthetic polypeptide
LTPDQVVAIASHDGGKQALETVQRQLPVLCQDHG

SEQ ID NO: 420 - protein, 34 aa, Artificial Sequence
  Description of Artificial Sequence: Synthetic polypeptide
LTPDQVVAIASHDGGKQALETVQRLAPVLCQDHG

SEQ ID NO: 421 - protein, 34 aa, Artificial Sequence
  Description of Artificial Sequence: Synthetic polypeptide
LTPDQVVAIASHDGGKQALETVQRLLAVLCQDHG

SEQ ID NO: 422 - protein, 34 aa, Artificial Sequence
  Description of Artificial Sequence: Synthetic polypeptide
LTPDQVVAIASHDGGKQALETVQRLLLVLCQDHG

SEQ ID NO: 423 - protein, 34 aa, Artificial Sequence; identical to SEQ ID NO: 334
  Description of Artificial Sequence: Synthetic polypeptide

SEQ ID NO: 424 - protein, 34 aa, Artificial Sequence; identical to SEQ ID NO: 338
  Description of Artificial Sequence: Synthetic polypeptide

SEQ ID NO: 425 - protein, 34 aa, Artificial Sequence
  Description of Artificial Sequence: Synthetic polypeptide
LSTAQVVAIASHDGGKQALEAVRALLPVLCQDHG

SEQ ID NO: 426 - DNA, 53 bp, Artificial Sequence
  Description of Artificial Sequence: Synthetic primer
ctacactctttccctacacgacgctcttccgatctggagcttgatcgacgaga

SEQ ID NO: 427 - DNA, 52 bp, Artificial Sequence
  Description of Artificial Sequence: Synthetic primer
ctacactctttccctacacgacgctcttccgatctctgtggaggcggatgat

SEQ ID NO: 428 - DNA, 52 bp, Artificial Sequence
  Description of Artificial Sequence: Synthetic primer
ctacactctttccctacacgacgctcttccgatctactacctccggcccaac

SEQ ID NO: 429 - DNA, 59 bp, Artificial Sequence
  Description of Artificial Sequence: Synthetic primer
ctacactctttccctacacgacgctcttccgatctggccgctgcagactctatctcacc

SEQ ID NO: 430 - DNA, 59 bp, Artificial Sequence
  Description of Artificial Sequence: Synthetic primer
ctacactctttccctacacgacgctcttccgatctttccgctgcagactctatctcacc

SEQ ID NO: 431 - DNA, 59 bp, Artificial Sequence
  Description of Artificial Sequence: Synthetic primer
ctacactctttccctacacgacgctcttccgatctccgggctgcagactctatctcacc

SEQ ID NO: 432 - DNA, 59 bp, Artificial Sequence
  Description of Artificial Sequence: Synthetic primer
ctacactctttccctacacgacgctcttccgatctaaccgctgcagactctatctcacc

SEQ ID NO: 433 - DNA, 59 bp, Artificial Sequence
  Description of Artificial Sequence: Synthetic primer
ctacactctttccctacacgacgctcttccgatctccaagctgcagactctatctcacc

SEQ ID NO: 434 - DNA, 52 bp, Artificial Sequence
  Description of Artificial Sequence: Synthetic primer
caagcagaagacggcatacgagctcttccgatctttccctccatttgccttc

SEQ ID NO: 435 - DNA, 52 bp, Artificial Sequence
  Description of Artificial Sequence: Synthetic primer
caagcagaagacggcatacgagctcttccgatctgtgtgtgggtgcaggttt

SEQ ID NO: 436 - DNA, 52 bp, Artificial Sequence
  Description of Artificial Sequence: Synthetic primer
caagcagaagacggcatacgagctcttccgatcttcgtcgtcagctcgtgta

SEQ ID NO: 437 - DNA, 52 bp, Artificial Sequence
  Description of Artificial Sequence: Synthetic primer
caagcagaagacggcatacgagctcttccgatcttgccaggaacactttcca

SEQ ID NO: 438 - DNA, 52 bp, Artificial Sequence; identical to SEQ ID NO: 437
  Description of Artificial Sequence: Synthetic primer

SEQ ID NO: 439 - DNA, 52 bp, Artificial Sequence; identical to SEQ ID NO: 437
  Description of Artificial Sequence: Synthetic primer

SEQ ID NO: 440 - DNA, 52 bp, Artificial Sequence; identical to SEQ ID NO: 437
  Description of Artificial Sequence: Synthetic primer

SEQ ID NO: 441 - DNA, 52 bp, Artificial Sequence; identical to SEQ ID NO: 437
  Description of Artificial Sequence: Synthetic primer

SEQ ID NO: 442 - DNA, 43 bp, Artificial Sequence
  Description of Artificial Sequence: Synthetic primer
aatgatacggcgaccaccgagatctacactctttccctacacg

SEQ ID NO: 443 - DNA, 18 bp, Artificial Sequence
  Description of Artificial Sequence: Synthetic primer
caagcagaagacggcata

SEQ ID NO: 444 - DNA, 8152 bp, Artificial Sequence
  Description of Artificial Sequence: Synthetic polynucleotide
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttttaattaatgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggactagtccagtgtggtggaattcgccatggactacaaagaccatgacggtgattataaagatcatgacatcgattacaaggatgacgatgacaagatggcccccaagaagaagaggaaggtgggcattcacggggtacctatggtggacttgaggacactcggttattcgcaacagcaacaggagaaaatcaagcctaaggtcaggagcaccgtcgcgcaacaccacgaggcgcttgtggggcatggcttcactcatgcgcatattgtcgcgctttcacagcaccctgcggcgcttgggacggtggctgtcaaataccaagatatgattgcggccctgcccgaagccacgcacgaggcaattgtaggggtcggtaaacagtggtcgggagcgcgagcacttgaggcgctgctgactgtggcgggtgagcttagggggcctccgctccagctcgacaccgggcagctgctgaagatcgcgaagagagggggagtaacagcggtagaggcagtgcacgcctggcgcaatgcgctcaccggggcccccttgaacctgaccccagaccaggtagtcgcaatcgcgtcgcatgacgggggaaagcaagccctggaaaccgtgcaaaggttgttgccggtcctttgtcaagaccacggccttacaccggagcaagtcgtggccattgcatcacatgacggtggcaaacaggctcttgagacggttcagagacttctcccagttctctgtcaagcccacgggctgactcccgatcaagttgtagcgattgcgagcaatgggggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatggactcaccccagaccaggtagtcgcaatcgcgtcgcatgacgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgagcaacatcggagggaaacaagcattggagactgtccaacggctccttcccgtgttgtgtcaagcccacggtttgacgcctgcacaagtggtcgccatcgcctcccacgacggcggtaagcaggcgctggaaacagtacagcgcctgctgcctgtactgtgccaggatcatgggctgaccccagaccaggtagtcgcaatcgccaacaataacgggggaaagcaagccctggaaaccgtgcaaaggttgttgccggtcctttgtcaagaccacggccttacaccggagcaagtcgtggccattgcatcaaatatcggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgccaacaacaacggcggtaagcaggcgctggaaacagtacagcgcctgctgcctgtactgtgccaggatcatggtttgaccccagaccaggtagtcgcaatcgcgtcgaacattgggggaaagcaagccctggaaaccgtgcaaaggttgttgccggtcctttgtcaagaccacggccttacaccggatcaagtcgtggccattgcaaataataacggtggcaaacaggctcttgagacggttcagagacttctcccagttctctgtcaagcccacgggctgactcccgatcaagttgtagcgattgcgaataacaatggagggaaacaagcattggagactgtccaacggctccttcccgtgttgtgtcaagcccacggtttgacgcctgcacaagtggtcgccatcgcctccaatattggcggtaagcaggcgctggaaacagtacagcgcctgctgcctgtactgtgccaggatcatggcctgacacccgaacaggtggtcgccattgctagcaacgggggaggacggccagccttggagtccatcgtagcccaattgtccaggcccgatcccgcgttggctgcgttaacgaatgaccatctggtggcgttggcatgtcttggtggacgacccgcgctcgatgcagtcaaaaagggtctgcctcatgctcccgcattgatcaaaagaaccaaccggcggattcccgagagaacttcccatcgagtcgcgggatcccagctggttaaatcagaactcgaagaaaaaaagagcgagctgcggcataaactcaaatatgtccctcatgagtacatagaactgattgaaatcgcccgcaattccacccaggatcggattcttgaaatgaaagtgatggaattttttatgaaagtttacggctatcgcgggaagcaccttggggggtcgcggaagccggacggtgctatttacactgtcggttccccgatcgattatggcgtaattgttgacacgaaagcatattcgggtgggtataatcttcctattggtcaggctgatgagatgcagcggtacgttgaagagaatcagacgcggaacaagcatattaacccaaatgagtggtggaaggtgtatccatcatcggtcaccgaatttaagttcttgtttgtgtcgggccactttaaggggaactacaaggcccaacttaccaggttgaatcacataaccaactgtaacggagctgttctgtcagtagaagagctgttgataggcggggaaatgattaaagcaggtacattaacgttggaggaagtacgccgcaagtttaataacggcgagattaactttagatctgagacctgataaacaaacacacggtctcctcgagctcgcagatcgttcaacatctggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccgataagcttaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 445 - DNA, 17 bp, Homo sapiens
tcattacacctgcagct

SEQ ID NO: 446 - DNA, 17 bp, Homo sapiens
acacctgcagctctcat

SEQ ID NO: 447 - DNA, 77 bp, Homo sapiens
aaaaagaaggtcttcattacacctgcagctctcattttccatacagtcagtatcaattctggaagaatttccagaca

SEQ ID NO: 448 - DNA, 77 bp, Homo sapiens
tgtctggaaattcttccagaattgatactgactgtatggaaaatgagagctgcaggtgtaatgaagaccttcttttt

SEQ ID NO: 449 - DNA, 13 bp, Homo sapiens
tgatactgactgt

SEQ ID NO: 450 - DNA, 17 bp, Homo sapiens
cttccagaattgatact

SEQ ID NO: 451 - protein, 83 aa, Artificial Sequence
  Description of Artificial Sequence: Synthetic polypeptide
LTPEQVVAIASNGGGRPALESIVAQLSRPDPALAALTNDHLVALACLGGRPALDAVKKGLPHAPALIKRTNRRIPERTSHRVA

SEQ ID NO: 452 - DNA, 400 bp, Artificial Sequence
  Description of Artificial Sequence: Synthetic polynucleotide
tgcgccgggctgcgtcgcggggcggtgcgcggagctgttcggaagggagaggagcttcaactctgagtcccgtgaacagaatctgcgcggttataaccagccaacccggccagatggctccagatcggaagagcgtcgtgtagggaaagagtgtagatctcggtggtcgccgtatcattaagggcgaattcgcggccatctttccaaagtcccactgggcggcagcatagtgagcccagaaggggacagtaagaaggaaaaacaggtcagagatggccaggttgagcaggtagatgtcagtcatgctcttcagccttttgcagtttatcaggatgaggatgaccagcatgttgcccacaaaaccaaagatgaacaccagtgagtagagcggaggcaggag

SEQ ID NO: 453 - DNA, 20 bp, Artificial Sequence
  Description of Artificial Sequence: Synthetic primer
ggaggcaagaagatggattc

SEQ ID NO: 454 - DNA, 20 bp, Artificial Sequence
  Description of Artificial Sequence: Synthetic primer
gaatcggcacatgcagatct

SEQ ID NO: 455 - DNA, 14 bp, Homo sapiens
tttgtgggcaacat

SEQ ID NO: 456 - DNA, 17 bp, Homo sapiens
tttgtgggcaacatgct

SEQ ID NO: 457 - DNA, 14 bp, Homo sapiens
tgctcttcagcctt

SEQ ID NO: 458 - DNA, 16 bp, Homo sapiens
tcatgctcttcagcct

SEQ ID NO: 459 - DNA, 15 bp, Homo sapiens
tgtcagtcatgctct

SEQ ID NO: 460 - DNA, 17 bp, Homo sapiens
tagatgtcagtcatgct

SEQ ID NO: 461 - protein, 34 aa, Artificial Sequence
  Description of Artificial Sequence: Synthetic polypeptide
  MOD_RES (2)..(2): Thr or unknown amino acid
  MOD_RES (3)..(3): Pro or Leu
  MOD_RES (4)..(4): Asp, Ala, Glu, or unknown amino acid
  MOD_RES (8)..(8): Ala or unknown amino acid
  MOD_RES (11)..(11): Ser or Asn
  MOD_RES (12)..(12): Asn or His
  MOD_RES (13)..(13): Asp, Gly, Ile, Asn, or Ser
  MOD_RES (15)..(15): Gly or unknown amino acid
  MOD_RES (22)..(22): Val or unknown amino acid
  MOD_RES (24)..(24): Arg or unknown amino acid
  MOD_RES (31)..(31): Gln or unknown amino acid
  MOD_RES (32)..(32): Asp, Ala, or unknown amino acid
LXXXQVVXIAXXXGXKQALETXQXLLPVLCXXHG

SEQ ID NO: 462 - DNA, 70 bp, Artificial Sequence
  Description of Artificial Sequence: Synthetic oligonucleotide
gtcttcattacacctgcagctctcattttccatacagtcagtatcaattctggaagaatttccagacatt

SEQ ID NO: 463 - DNA, 70 bp, Artificial Sequence
  Description of Artificial Sequence: Synthetic oligonucleotide
aatgtctggaaattcttccagaattgatactgactgtatggaaaatgagagctgcaggtgtaatgaagac

SEQ ID NO: 464 - protein, 4 aa, Artificial Sequence
  Description of Artificial Sequence: Synthetic peptide
SGGS

SEQ ID NO: 465 - DNA, 18 bp, Zea maize
tgaactagtgggagtgtt

SEQ ID NO: 466 - DNA, 18 bp, Zea maize
tcgtccacgcccctctct

SEQ ID NO: 467 - DNA, 70 bp, Zea maize
gagcgcgatggggaggagggcgtgctgcgcgaaggaaggcgttaagagaggggcgtggacgagcaaggag

SEQ ID NO: 468 - DNA, 63 bp, Artificial Sequence
  Description of Artificial Sequence: Synthetic oligonucleotide
gagcgcgatggggaggagggcgtgctgcgcgacgttaagagaggggcgtggacgagcaaggag

SEQ ID NO: 469 - DNA, 68 bp, Artificial Sequence
  Description of Artificial Sequence: Synthetic oligonucleotide
gagcgcgatggggaggagggcgtgctgcgcgaaggagcgttaagagaggggcgtggacgagcaaggag

SEQ ID NO: 470 - DNA, 67 bp, Artificial Sequence
  Description of Artificial Sequence: Synthetic oligonucleotide
gagcgcgatggggaggagggcgtgctgcgcgaaaggcgttaagagaggggcgtggacgagcaaggag

SEQ ID NO: 471 - DNA, 65 bp, Artificial Sequence
  Description of Artificial Sequence: Synthetic oligonucleotide
gagcgcgatggggaggagggcgtgctgcgcgaggcgttaagagaggggcgtggacgagcaaggag

SEQ ID NO: 472 - DNA, 67 bp, Artificial Sequence
  Description of Artificial Sequence: Synthetic oligonucleotide
gagcgcgatggggaggagggcgtgctgtgcgaaaggcgttaagagaggggcgtggacgagcaaggag

SEQ ID NO: 473 - DNA, 66 bp, Artificial Sequence
  Description of Artificial Sequence: Synthetic oligonucleotide
gagcgcgatggggaggagggcgtgctgcgcgaaggcgttaagagaggggcgtggacgagcaaggag

SEQ ID NO: 474 - DNA, 65 bp, Artificial Sequence
  Description of Artificial Sequence: Synthetic oligonucleotide
gagcgcgatggggaggagggcgtgcagcgcgaggcgttaagagaggggcgtggacgagcaaggag

SEQ ID NO: 475 - DNA, 51 bp, Artificial Sequence
  Description of Artificial Sequence: Synthetic oligonucleotide
gagcgcgatggggaggaaggcgttaagagaggggcgtggacgagcaaggag

SEQ ID NO: 476 - DNA, 70 bp, Zea maize
gagatcctcctcgtcgtaggagatgttgccgcgcctgatgttgggccggaggtagttcagccaccgcagc

SEQ ID NO: 477 - DNA, 55 bp, Artificial Sequence
  Description of Artificial Sequence: Synthetic oligonucleotide
gagatcctcctcgtcgtaggagatgttgggccggaggtagttcagccaccgcagc

SEQ ID NO: 478 - DNA, 64 bp, Artificial Sequence
  Description of Artificial Sequence: Synthetic oligonucleotide
gagatcctcctcgtcgtaggagatgttgctgatgttgggccggaggtagttcagccaccgcagc

SEQ ID NO: 479 - DNA, 68 bp, Artificial Sequence
  Description of Artificial Sequence: Synthetic oligonucleotide
gagatcctcctcgtcgtaggagatgttgccgcctgatgttgggccggaggtagttcagccaccgcagc

SEQ ID NO: 480 - DNA, 68 bp, Artificial Sequence; identical to SEQ ID NO: 479
  Description of Artificial Sequence: Synthetic oligonucleotide

SEQ ID NO: 481 - DNA, 64 bp, Artificial Sequence
  Description of Artificial Sequence: Synthetic oligonucleotide
gagatcctcctcgtcgtaggagatgttgctgatgttgggccgggggtagttcagccaccgcagc

SEQ ID NO: 482 - DNA, 55 bp, Artificial Sequence; identical to SEQ ID NO: 477
  Description of Artificial Sequence: Synthetic oligonucleotide

SEQ ID NO: 483 - DNA, 66 bp, Artificial Sequence
  Description of Artificial Sequence: Synthetic oligonucleotide
gagatcctcctcgtcgtaggagatgttgccgcgatgttgggccggaggtagttcagccaccgcagc

SEQ ID NO: 484 - DNA, 65 bp, Artificial Sequence
  Description of Artificial Sequence: Synthetic oligonucleotide
gagatcctcctcgtcgtaggagatgttgcctgatgttgggccggaggtagttcagccaccgcagc

SEQ ID NO: 485 - DNA, 66 bp, Artificial Sequence
  Description of Artificial Sequence: Synthetic oligonucleotide
gagatcctcctcgtcgtaggagatgttgccctgatgttgggccggaggtagttcagccaccgcagc

SEQ ID NO: 486 - DNA, 64 bp, Artificial Sequence
  Description of Artificial Sequence: Synthetic oligonucleotide
gagatcctcctcgtcgtaggagatgttgccgatgttgggccggaggtagttcagccaccgcagc

SEQ ID NO: 487 - DNA, 70 bp, Zea maize
ggcaacatctcctacgacgaggaggatctcatcatccgcctccacaggctcctcggcaacaggtcggtgc

SEQ ID NO: 488 - DNA, 65 bp, Artificial Sequence
  Description of Artificial Sequence: Synthetic oligonucleotide
ggcaacatctcctacgacgaggaggatctcatccctccacaggctcctcggcaacaggtcggtgc

SEQ ID NO: 489 - DNA, 66 bp, Artificial Sequence
  Description of Artificial Sequence: Synthetic oligonucleotide
ggcaacatctcctacgacgaggaggatctcatcgcctccacaggctcctcggcaacaggtcggtgc

SEQ ID NO: 490 - DNA, 70 bp, Zea maize
ctcggaagttatttgaagaaactatattacagagcataagcttatgcaacactcccactagttcattttt

SEQ ID NO: 491 - DNA, 72 bp, Artificial Sequence
  Description of Artificial Sequence: Synthetic oligonucleotide
ctcggaagttatttgaagaaactatattacagagcatataagcttatgcaacactcccactagttcattttt

SEQ ID NO: 492 - DNA, 61 bp, Artificial Sequence
  Description of Artificial Sequence: Synthetic oligonucleotide
ctcggaagttatttgaagaaactatattaagcttatgcaacactcccactagttcattttt

SEQ ID NO: 493 - DNA, 68 bp, Artificial Sequence
  Description of Artificial Sequence: Synthetic oligonucleotide
ctcggaagttatttgaagaaactatattacagagcaagcttatgcaacactcccactagttcattttt

SEQ ID NO: 494 - DNA, 62 bp, Artificial Sequence
  Description of Artificial Sequence: Synthetic oligonucleotide
ctcggaagttatttgaagaaactatattacagcttatgcaacactcccactagttcattttt

SEQ ID NO: 495 - DNA, 38 bp, Artificial Sequence
  Description of Artificial Sequence: Synthetic oligonucleotide
ctcggaagcttatgcaacactcccactagttcattttt

SEQ ID NO: 496 - DNA, 51 bp, Artificial Sequence
  Description of Artificial Sequence: Synthetic oligonucleotide
ctcggaagttatttgaagaaactatatcaacactcccactagttcattttt

SEQ ID NO: 497 - DNA, 62 bp, Artificial Sequence
  Description of Artificial Sequence: Synthetic oligonucleotide
ctcggaagttatttgaagaaactatattgcagcttatgcaacactcccactagttcattttt

SEQ ID NO: 498 - DNA, 47 bp, Artificial Sequence
  Description of Artificial Sequence: Synthetic oligonucleotide
ctcggaagtggcataagcttatgcaacactcccactagttcattttt

SEQ ID NO: 499 - DNA, 51 bp, Artificial Sequence
  Description of Artificial Sequence: Synthetic oligonucleotide
ctcggaagttatttgaagaaacttatgcaacactcccactagttcattttt

SEQ ID NO: 500 - DNA, 58 bp, Artificial Sequence
  Description of Artificial Sequence: Synthetic oligonucleotide
ctcggaagttatttgaagaaactatattacagagcaacactcccactagttcattttt

SEQ ID NO: 501 - DNA, 70 bp, Zea maize; identical to SEQ ID NO: 490

SEQ ID NO: 502 - DNA, 63 bp, Artificial Sequence
  Description of Artificial Sequence: Synthetic oligonucleotide
ctcggaagttatttgaagaaactatattacaagcttatgcaacactcccactagttcattttt

SEQ ID NO: 503 - DNA, 65 bp, Artificial Sequence
  Description of Artificial Sequence: Synthetic oligonucleotide
ctcggaagttatttgaagaaactatattacagaagcttatgcaacactcccactagttcattttt

SEQ ID NO: 504 - DNA, 64 bp, Artificial Sequence
  Description of Artificial Sequence: Synthetic oligonucleotide
ctcggaagttatttgaagaaactatattacagagcttatgcaacactcccactagttcattttt

SEQ ID NO: 505 - DNA, 68 bp, Artificial Sequence
  Description of Artificial Sequence: Synthetic oligonucleotide
ctcggaagttatttgaagaaactatattacagcataagcttatgcaacactcccactagttcattttt

SEQ ID NO: 506 - DNA, 66 bp, Artificial Sequence
  Description of Artificial Sequence: Synthetic oligonucleotide
ctcggaagttatttgaagaaactatattacagtaagcttatgcaacactcccactagttcattttt

SEQ ID NO: 507 - DNA, 64 bp, Artificial Sequence
  Description of Artificial Sequence: Synthetic oligonucleotide
ctcggaagttatttgaagaaactatattactaagcttatgcaacactcccactagttcattttt

SEQ ID NO: 508 - DNA, 64 bp, Artificial Sequence
  Description of Artificial Sequence: Synthetic oligonucleotide
ctcggaagttatttgaagaaactatattacaaagcttatgcaacactcccactagttcattttt

SEQ ID NO: 509 - DNA, 67 bp, Artificial Sequence
  Description of Artificial Sequence: Synthetic oligonucleotide
ctcggaagttatttgaagaaactatattacagataagcttatgcaacactcccactagttcattttt

SEQ ID NO: 510 - DNA, 38 bp, Artificial Sequence; identical to SEQ ID NO: 495
  Description of Artificial Sequence: Synthetic oligonucleotide

SEQ ID NO: 511 - DNA, 63 bp, Artificial Sequence
  Description of Artificial Sequence: Synthetic oligonucleotide
ctcggaagttatttgaagaaactatattaaaagcttatgcaacactcccactagttcattttt

SEQ ID NO: 512 - DNA, 70 bp, Zea maize; identical to SEQ ID NO: 490

SEQ ID NO: 513 - DNA, 58 bp, Artificial Sequence
  Description of Artificial Sequence: Synthetic oligonucleotide
ctcggaagttatttgaagaaactatattaccatgcaacactcccactagttcattttt

SEQ ID NO: 514 - DNA, 56 bp, Artificial Sequence
  Description of Artificial Sequence: Synthetic oligonucleotide
ctcggaagttatttgaagaaactatatttatgcaacactcccactagttcattttt

SEQ ID NO: 515 - DNA, 60 bp, Artificial Sequence
  Description of Artificial Sequence: Synthetic oligonucleotide
ctcggaagttatttgaagaaactatattaccttatgcaacactcccactagttcattttt

SEQ ID NO: 516 - DNA, 52 bp, Artificial Sequence
  Description of Artificial Sequence: Synthetic oligonucleotide
ctcggaagttatttgaagaaactatatgcaacactcccactagttcattttt

SEQ ID NO: 517 - DNA, 55 bp, Artificial Sequence
  Description of Artificial Sequence: Synthetic oligonucleotide
ctcggaagttatttgaagaaactatattatgcaacactcccactagttcattttt

SEQ ID NO: 518 - DNA, 59 bp, Artificial Sequence
  Description of Artificial Sequence: Synthetic oligonucleotide
ctcggaagttatttgaagaaactatattacatatgcaacactcccactagttcattttt

SEQ ID NO: 519 - DNA, 68 bp, Artificial Sequence
  Description of Artificial Sequence: Synthetic oligonucleotide
ctcggaagttatttgaagaaactatattacagagcatacttatgcaacactcccactagttcattttt

SEQ ID NO: 520 - DNA, 59 bp, Artificial Sequence
  Description of Artificial Sequence: Synthetic oligonucleotide
ctcggaagttatttgaagaaactatattacagatgcaacactcccactagttcattttt

SEQ ID NO: 521 - DNA, 67 bp, Artificial Sequence
  Description of Artificial Sequence: Synthetic oligonucleotide
ctcggaagttatttgaagaaactatattacagagcatattatgcaacactcccactagttcattttt

SEQ ID NO: 522 - DNA, 60 bp, Artificial Sequence
  Description of Artificial Sequence: Synthetic oligonucleotide
ctcggaagttatttgaagaaactatattacaatatgcaacactcccactagttcattttt

SEQ ID NO: 523 - DNA, 70 bp, Zea maize; identical to SEQ ID NO: 490

SEQ ID NO: 524 - DNA, 66 bp, Artificial Sequence
  Description of Artificial Sequence: Synthetic oligonucleotide
ctcggaagttatttgaagaaactatattacagagagcttatgcaacactcccactagttcattttt

SEQ ID NO: 525 - DNA, 65 bp, Artificial Sequence; identical to SEQ ID NO: 503
  Description of Artificial Sequence: Synthetic oligonucleotide

SEQ ID NO: 526 - DNA, 64 bp, Artificial Sequence; identical to SEQ ID NO: 504
  Description of Artificial Sequence: Synthetic oligonucleotide

SEQ ID NO: 527 - DNA, 67 bp, Artificial Sequence
  Description of Artificial Sequence: Synthetic oligonucleotide
ctcggaagttatttgaagaaactatattacagagaagcttatgcaacactcccactagttcattttt

SEQ ID NO: 528 - DNA, 67 bp, Artificial Sequence
  Description of Artificial Sequence: Synthetic oligonucleotide
ctcggaagttatttgaagaaactatattacagagcagcttatgcaacactcccactagttcattttt

SEQ ID NO: 529 - DNA, 68 bp, Artificial Sequence; identical to SEQ ID NO: 493
  Description of Artificial Sequence: Synthetic oligonucleotide

SEQ ID NO: 530 - DNA, 66 bp, Artificial Sequence
  Description of Artificial Sequence: Synthetic oligonucleotide
ctcggaagttatttgaagaaactatattacagaaagcttatgcaacactcccactagttcattttt

SEQ ID NO: 531 - DNA, 38 bp, Artificial Sequence; identical to SEQ ID NO: 495
  Description of Artificial Sequence: Synthetic oligonucleotide

SEQ ID NO: 532 - DNA, 66 bp, Artificial Sequence
  Description of Artificial Sequence: Synthetic oligonucleotide
ctcggaagttatttgaagaaactatattacagagcgcttatgcaacactcccactagttcattttt

SEQ ID NO: 533 - DNA, 65 bp, Artificial Sequence
  Description of Artificial Sequence: Synthetic oligonucleotide
ctcggaagttatttgaagaaactatattacagaggcttatgcaacactcccactagttcattttt

SEQ ID NO: 534 - DNA, 70 bp, Zea maize; identical to SEQ ID NO: 490

SEQ ID NO: 535 - DNA, 64 bp, Artificial Sequence; identical to SEQ ID NO: 504
  Description of Artificial Sequence: Synthetic oligonucleotide

SEQ ID NO: 536 - DNA, 68 bp, Artificial Sequence; identical to SEQ ID NO: 493
  Description of Artificial Sequence: Synthetic oligonucleotide

SEQ ID NO: 537 - DNA, 67 bp, Artificial Sequence; identical to SEQ ID NO: 528
  Description of Artificial Sequence: Synthetic oligonucleotide

SEQ ID NO: 538 - DNA, 66 bp, Artificial Sequence; identical to SEQ ID NO: 532
  Description of Artificial Sequence: Synthetic oligonucleotide

SEQ ID NO: 539 - DNA, 66 bp, Artificial Sequence
  Description of Artificial Sequence: Synthetic oligonucleotide
ctcggaagttatttgaagaaactatattacagagcacttatgcaacactcccactagttcattttt

SEQ ID NO: 540 - DNA, 60 bp, Artificial Sequence
  Description of Artificial Sequence: Synthetic oligonucleotide
ctcggaagttatttgaagaaactatattacagtatgcaacactcccactagttcattttt

SEQ ID NO: 541 - DNA, 63 bp, Artificial Sequence
  Description of Artificial Sequence: Synthetic oligonucleotide
ctcggaagttatttgaagaaactatattacagagctatgcaacactcccactagttcattttt

SEQ ID NO: 542 - DNA, 61 bp, Artificial Sequence
  Description of Artificial Sequence: Synthetic oligonucleotide
ctcggaagttatttgaagaaactatattacagatatgcaacactcccactagttcattttt

SEQ ID NO: 543 - DNA, 55 bp, Artificial Sequence; identical to SEQ ID NO: 517
  Description of Artificial Sequence: Synthetic oligonucleotide

SEQ ID NO: 544 - DNA, 51 bp, Artificial Sequence; identical to SEQ ID NO: 499
  Description of Artificial Sequence: Synthetic oligonucleotide

SEQ ID NO: 545 - DNA, 74 bp, Homo sapiens
gttttgtgggcaacatgctggtcatcctcatcctgataaactgcaaaaggctgaagagcatgactgacatctac

SEQ ID NO: 546 - DNA, 74 bp, Homo sapiens
gtagatgtcagtcatgctcttcagccttttgcagtttatcaggatgaggatgaccagcatgttgcccacaaaac

SEQ ID NO: 547 - DNA, 14 bp, Artificial Sequence
  Description of Artificial Sequence: Synthetic oligonucleotide
tataaataccttct

SEQ ID NO: 548 - DNA, 19 bp, Artificial Sequence
  Description of Artificial Sequence: Synthetic oligonucleotide
tggagccatctggccgggt

SEQ ID NO: 549 - DNA, 19 bp, Artificial Sequence
  Description of Artificial Sequence: Synthetic oligonucleotide
tgaacagaatctgcgcggt

SEQ ID NO: 550 - DNA, 52 bp, Artificial Sequence
  Description of Artificial Sequence: Synthetic oligonucleotide
gtgaacagaatctgcgcggttataaccagccaacccggccagatggctccgc

SEQ ID NO: 551 - DNA, 33 bp, Artificial Sequence; identical to SEQ ID NO: 89
  Description of Artificial Sequence: Synthetic oligonucleotide

SEQ ID NO: 552 - DNA, 52 bp, Artificial Sequence; identical to SEQ ID NO: 550
  Description of Artificial Sequence: Synthetic oligonucleotide

SEQ ID NO: 553 - DNA, 33 bp, Artificial Sequence; identical to SEQ ID NO: 91
  Description of Artificial Sequence: Synthetic oligonucleotide

SEQ ID NO: 554 - protein, 34 aa, Artificial Sequence; identical to SEQ ID NO: 2
  Description of Artificial Sequence: Synthetic polypeptide

SEQ ID NO: 555 - protein, 34 aa, Artificial Sequence; identical to SEQ ID NO: 6
  Description of Artificial Sequence: Synthetic polypeptide

---

What is claimed is:

1. An isolated, non-naturally occurring DNA-binding polypeptide comprising:
    two or more TALE-repeat units, the TALE repeat units comprising a repeat variable di-residue (RVD);
    an N-cap polypeptide, wherein the N-cap comprises residues N+1 to N+121 of a TALE protein; and
    a C-cap polypeptide, wherein the C-cap polypeptide comprises a fragment of a full length C-terminus region of a TALE protein, the C-cap comprising residues C-1 to C-20 of the TALE protein,
    wherein the polypeptide binds to DNA.

2. The isolated polypeptide of claim 1, wherein at least one TALE-repeat unit comprises an atypical repeat variable di-residue (RVD).

3. The polypeptide of claim 2, wherein the protein comprises an atypical RVD as shown in Tables 27A or 27B.

4. The polypeptide of claim 1, wherein the C-cap polypeptide is less than approximately 230 amino acids in length.

5. The polypeptide of claim 1, wherein the C-cap comprises a TALE repeat domain.

6. A fusion protein comprising the polypeptide of claim 1 and at least one functional domain.

7. The fusion protein of claim 6, wherein the functional domain is a transcriptional activator or a transcriptional repressor.

8. The fusion protein of claim 7, wherein the functional domain comprises a nuclease.

9. The fusion protein of claim 8, wherein the nuclease comprises at least one cleavage domain or cleavage half-domain from a TypeIIS endonuclease.

10. A host cell comprising a polypeptide according to claim 1.

11. A pharmaceutical composition comprising a polypeptide according to claim 1.

* * * * *